United States Patent 6,964,868 (HUMAN GENES AND GENE EXPRESSION PRODUCTS II) - sequence listing, part 2

SEQ ID NO: 3636 - DNA, 770 bp, Homo sapiens
  misc_feature (1)...(770): n = A,T,C or G
tnacnaattantntgctctcgtnctttccgnaanaannnggcgnntcgttgagacggagtttcaccatgttggccaggatggtcttcaacttctaacttcgtgatccacgctgctgggattacaggtgtgagccaccgcgtgtggcctctgggcaccttttgaagctgaagcagagagagaaggcggcaggcatcagcgttttcttctatgaacttataagatcaaagactttaagactttcactatttcttctaccgctatctactacgaacttcaaagaggaaccaggagtacggaaggagcatgaaagtggacaaggaacgtgaccattgaagcaccacagggaggggttcaggcctccggatgactgcaggcaggcctgggtaacatccagcctcccacaagaagctggtggagcagagcgttccctgactcctccaaggaaaggagactccctttcccggtctgctcagtaacgggtgccttcccagacactggcgttaccgcttgaccaaggggccctcaagcggcccttatgcgggcatgacagaaggctcccctcttgccttctattcacttctcacaatgtcccttcagcacctgaccctatacctgccggttattcctaggttatattattaatgcaacagagtaatattaaaagctaatgattaataatgtttataataatgatggataattggttcatgatcatcgctgtatctaatttgnattatgactatncttattctattntctttatatactn

SEQ ID NO: 3637 - DNA, 770 bp, Homo sapiens; identical to SEQ ID NO: 3636
  misc_feature (1)...(770): n = A,T,C or G

SEQ ID NO: 3638 - DNA, 928 bp, Homo sapiens
  misc_feature (1)...(928): n = A,T,C or G
ctaannattaattanntagcctaaatngcnnaacnntgnttnngcttngggcccaancatggnncctnntaagtaagatntntnnnngggagctgganaatcagnactgtcccagccgatgggtngttccnactgggagcanangaagccttgaggacctactcacanatangaattgaagattatcttnaaaacaatcttccactanttctgacnatacttggagcctgntccacgtgcatnccaccttgggaagcctctncaaagagctttcngagctnacactgacagntncantttcccncanaacccacnatagcctngctgngtctgtctncccggcangagtccatnctcactgccgggacactcatnacantctccacgntctncctcttcccancctgnatggagcctccnnggctnnngaacgntncccaagtcaatnctcacnnatnccngnagctgcctntnagcactnntcttggcccanctccctccttgacanaatcatnacccancatgacncncactnngccatnccnntcnacantttttnntcntcattncatnttntctncccatngnnacntcnnaaccnnctagtanaccccancantctcgnnatctncncaaccngnncancnanacntttgntctttntncnntntgatcntccacctnntcttntctnncnatntncaataatcntaattcctanacatnctactcttaaacntccnttncttannttcccacacatctgttnatacntatccctncctncccatgnntnnnatctcanntccccnngncctnnannatnttactcagccctntcctttatnnanntcnntncaccncgnnagtnnnnccatancnnanatttnnncancacancnctctcntnttttcaaacctncncccg

SEQ ID NO: 3639 - DNA, 781 bp, Homo sapiens
  misc_feature (1)...(781): n = A,T,C or G
gaacntatctntgtgtagctcgnantnncctaaatanaataggctgggngaattcggcacgagagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgnctcttcaaccatctggggtgccaacaagtggaccatcntcagaccaccatacacttactacctacagcttcaactacccgngaatgtaacacatcgtccagtaactcangtgacccacaagaatnccctgtaccaagagctccttnnaaaccaccann

SEQ ID NO: 3640 - DNA, 924 bp, Homo sapiens
  misc_feature (1)...(924): n = A,T,C or G
ctaacnaattantgngnangctcgtncttnccgaacnanannggcgggggcgaattcggcacgagatttagtcactagctataatacatttagtgaacaaatgtagtcttgcactaaaattagagaatacctatccttttcaagaatacataaaataatgaccatatatataccacagagtaagctgcaaccaattctagataacttaaatacagaccatgtttggaaatttaagaaaaaaaaacacatttataacttgtggatcaaaaaagtcatagaacttagacaatacttggaactgaatgtaaatacaaatgctattaaaatttgtagtatgcagttaaacaggacttgtatacgcatttatatatctaaatgcatgtattagtaaagaaaaacaaatagaaaattaagtttccaactgaaaaagttagagaacaacagatccatcagaggaagtagacagaagttataaagagttataaaggtaaccaggcatggtggtgcacaccctatagccctagctactcngnangnnnngnnggtnncnaggnttgcttgnncncnngaatccnacngtccnnncngnccnattgatcggcnnctgcncaatngnnctncttctancctcacccctnggtcnaccatanggnganncannncatactcntcngcacancctatttcctcnananggtnggntcctccnnnnnatcttncncnncntctcanctancttnncatnttnnctanntcnantcctccatattncnncntcncccnactactcgntnacgnctcnnctttctncaanannngngancctntnannngncaacatncntcngtnccncnncntnnnctnnntnnnccnncttctnnctctctntttcnnngcanannccanntnngnctcntcnntct

SEQ ID NO: 3641 - DNA, 868 bp, Homo sapiens
  misc_feature (1)...(868): n = A,T,C or G
ctaaaanaaggtngggggaattcggcacgaggtcaggctctgctggacactgcatgtccaaacgtcattttacccatgtgccagcgacaaggtagattcgcttgtnccaattttgcacataaggaaacagccttagagaggttaggttgcttgtgcaagcccagggtaggtggcacccagtctgccagtctgcaacgcactggtatcttncagccagtagaccttgctccctgggtgcccagttctggatctcaggaaangtggattaaggctcctagtggcgggacctgggtggggatttgctgccctctggtggcagaagggacatcaccctgggtgtgagacttgtgggcatctgtgaggcggtcttttcatccnanggaagccggacctcaaatctgacctcagccccaggaaggtgccancanganggtgccacctangagggtgccaccagggttccgccngggtctgctggggccctgctccatcttgnntganncacataancnctcaagctgtcacnagacccagggnttnactgtctgggntttganncctgtgnnngccccctgagccnatttgnctttntctcctctttggggcccctcanntttcccnttttcantttannanttctncnnantnnattaannctcccnggggccaaactntatncntaggaaacntncactncctnannaatttaaatttatnntctacacttcaactctnccatctnnnaactgcctnnacncnaatntatttcntnctnnnnctccnctntctanatcatcnnntctatcntcttatatnntcactnnnctnatnanaaaaactanncngtgcgtctttcnttagaacncct

SEQ ID NO: 3642 - DNA, 787 bp, Homo sapiens
  misc_feature (1)...(787): n = A,T,C or G
tnnacaattncncntgctactcgttctttccgcaatannnnntgctnttcgaattcggcacgaggccagtccctggacagctncgacgccatgaatatnttgcccangaagagctgncacgtncggaacanggacaatgtngnccgcntgcggngtgacgaggcccaggcccggnaggaggagaaggagcgtgagcggagggtgctgntggctcancaagaggcccgtncanaattcctacngaagaaagccanacatcagaactcactgcctgagcttgaagcagcagaggcgggagccccaggttntggccctgtggacctgtttcgggagctgntggaggaagggaaaggagtgatcataggcaataaagagtncgaggaagaaaagcgacaggatnaaaganaggcnngagaaagctctgggcatnctgacatacctgggccanagtgcatcngaggcacagactnaacccccttggtaccagcttcccccagggcgagggggccccccggccngtccagccccagatganangatcaagancctctggaccctctgcgggagatgcataagcatctggngaagaagagacagnacggcggtgatnaangcagtnncagctnaaaggaaaaggacgggtctnagaagcattacccaaggagccttcatacnttgaccagcttngaacttgaaccgtntgctgagggaaatcagctgtatangtctcnggcataagcccctgctggccccnggttccaaagcccnggcacttacanggagggnt

SEQ ID NO: 3643 - DNA, 787 bp, Homo sapiens; identical to SEQ ID NO: 3642
  misc_feature (1)...(787): n = A,T,C or G

SEQ ID NO: 3644 - DNA, 789 bp, Homo sapiens
  misc_feature (1)...(789): n = A,T,C or G
tnanctatngntgtgtnggctcgnnctttccnnannaaaagggctgtggcgaattcggcacgaggagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaaagtgaaggtcaaccggccgggcgggtccacagttaccagcacgcttgtcttagaaaacgaaaacngaggaaaaaaaccccaaaaccccaaacaatcttaantaaacacgactgagcaaanaaaagttggccctgtgtaagggctattttcacccacccggnaagtttttaggacncatttccccagaagaaccggaaaagatcatttgaccctnggaacn

SEQ ID NO: 3645 - DNA, 1098 bp, Homo sapiens
  misc_feature (1)...(1098): n = A,T,C or G
ttacttttcctncatccaggnctaantagcnctaacnngnttnanntngggnnttcgntacnantcanctttcnnagtnaccataagagcaaggggaactcgtacnacgnnnacgtngcgctgcancangnggacactggaaactcttacctttgcnggtacttnaanattaaangccttactgangagtatctcacccctntacaactcttctttgaanganaacntaatcatcntanaacacnctnccttaactcnnaagtcgnatgcanatcaacatnntnatccnaaacaccnngggcancntttctngctcctttatcanccnccnnaatcatttaacntcacnatcnacattcgncnatcatnncagcnagacanantgnanacctacatctntanntanntgcantngnncantcnncttgnntcccctancncacctntccanaagatatcnttngnngcnttntnncnnccccactatactnacatccnccntnctcagcaantttantntcnaccctcccnctnangancnnncntancnanccttntcccaacnantntaacaancntnaccannccangntctntnnctctntccctcacantacanaaatntctcaananctccccnacncnanctcanctnnntngtacaatccactcaatctcngngcnncccaccnantctttanctgggnaacctttnctcacatactancgcaanacaatnntcgcgntnnttctcnnanacacatctctccncanctnncntnatacnactatcatcntcnatnnncacttanngaccaaanntacactnganacnactactcgccantttcantanctnntantatcgctngtccactngcatctctancatnnntnnacaaaancncntccncncctanaactntcactntcatctanctctananactntctcnactnacccntcttataccacaannncccnanctnntgcnctcctcatantntntntatncnttcnntactactnnatntananctactactccacctcnnacatngcttntcatatncatatcctcatccttctcnnctncn

SEQ ID NO: 3646 - DNA, 783 bp, Homo sapiens
  misc_feature (1)...(783): n = A,T,C or G
ntaannngtgngnggtcgnnctanccnaacnanataggctggggcgatgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggagcaaggagtgggcacgcttctctgttacaaatagaaaacgattccagtcatacaggacacatccactccaaangatatttccaaaaacatacctctgacagtnactttgatagatggtttggcnaatgtatcttctgggtatccacacctcttggccatgaaatttgcagctcctcccttccataaatgaaagtctctttcccccaccatnttgaaatctnggctggcactgcgacttngantcgnttcaatacnaatngtnggangaangtgactgtttnncntttcccancctnggttttcaagaggccttnttaaatgccnngttggaaccttaccccnccctgnccntngtnnactgaccatggctggaaaantgacc

SEQ ID NO: 3647 - DNA, 823 bp, Homo sapiens
  misc_feature (1)...(823): n = A,T,C or G
ctaatnanngtgggacctcgnnatnnccnaaananaataggctggggcgaattcggcacgagagtgtgatctgcagggagagaaccaattacagtatgcttggagagggtgacatttattctgctgaacctcttctctgcttcacataacgttggccacttcacctttcctgagatgtctctgaggatgggcatattttaaagacttgagcttacatcatcgcatcttgaaagaaccgagtataattgagttgctgatacaagtgggtacttgcaccaggtccgggtcacccacatctctatggaaacacatgtttgctttaaagcccagcaatcagaagcagatccttataggagccagcattgggtcacttttagaaaaaggcatttatttatattctcaagccagcanagacctatgaaatgaaataattttcaaattcantagaaaaaccatgccgtacgtgaatgctaataaaagcctgccgtgcgtcctnnctcccctgtgctngcactgcctcagatccgcctgcatttatntttanctgtcctttgctcttntgtgcccatttgcattctgcngctgtgacnaagtnggtttggcccttttatgcnnaaatnggttaatcnttcatttnatnanncattttgcccancnacctaaaaantggggaaaaatntcaaaagcntggggaactggccnntcaaancngnnnnttnctggcggttcctngctnttngccctcngttcccttgcaagccnttntcccanccanccntncccccaangccnncttngaacncttnncnngccnttancaanc

SEQ ID NO: 3648 - DNA, 783 bp, Homo sapiens
  misc_feature (1)...(783): n = A,T,C or G
nnctaacngntnnttaaaggagntcganntngcctaacacaaataggctngggggaattcggcacgagtgagtacttatgaaaaattgtgagaaattcattgtgtgggattttcaccattactacatgtatttggaaataaaaattgtatgactatgtatatgaaacttgttcatgttctaaaaaataccctccatttataatatgtttttaaaatttgccactgagaagtacaaatttccttcttatttcatcttagttatcaacccagagtcactggaggcaatgcagtgtagtggttaagcgtgcagattctgaagttagacaagatttgggttggaatcctgactctgccacttactagctgggtattcttggaaaggtcagtttccccatccgtaaaatggggataggaatggtaccttcctcatatgattgntcttttttttaagatttaatgaataccttgatgtattcgtcacagtacttgggcatagtaagtgttcgataaatacgtantcccctgtgcccataactgtaatattttactagcactaaatttgtctactaattcttttggttagagaatctcccttgttaaatgactattttacagaatgttttgaactccaaatcaagcctaccacgattaatnatattaagaattttattttaactttataagggcttctaacagtangttaacccaattttaaaangtgaaattcaangtgttccctattaaaacccctattcctgaatgtanataatccattattnnnct

SEQ ID NO: 3649 - DNA, 827 bp, Homo sapiens
  misc_feature (1)...(827): n = A,T,C or G
ctaatnnnnggtantctgngttctttccgnannanaacnnnctnnggcgaattcggcacgaggcttcctgctctttgtattttggctaaaggcggtgaagtgagaggcggagggggatttaaaaccagcagaaaaaggcttcttgttgggctgatggtgtttgtgcgagaagctgangtgggcagggaggagagcctangagagcggtagggctcatgggcaggccgttggtgtacgccttggccctgcctgtccccagtcccaccactgtggactccaggccatcctcagtccaggtggtcactgtggcctgggccacatgctggcgatgacggggatggccttccacatgcctgttctctggaagaggggctcgcgttgtgcccaactggggacgtcctgcccccaaccccccaaaacgctgctttcttctgccctnaagaggcccctcagaagagaggaggctngnntgaggggcnttgagataaaccccgaaaggccggnttcctggcttcgtgttttaaaactcagtgctgcttgcnaagtgctttgnctattgcattnataatgaccaacancgnttggttgaccacnttgatggnccganggggtgccangcacttgttcccaagggccncacttcgtgttggttntttggtccgnttaattcctncttgacaaacctatttacaccggtttcntcnttcnnctntcnagcnaanccccaattntgcaaccccggnggaaaactnaangnccncaccggattcaccaaaaatgccnacnaaccttgntatttccaancccntnancctctcctgnncccc

SEQ ID NO: 3650 - DNA, 776 bp, Homo sapiens
  misc_feature (1)...(776): n = A,T,C or G
ntacnnatantntcgnngnnactcgnnctntccnaacncancnnggctgnggcgaattcggcacgaggtggcccaaggggcccacaataaataacacagtcactcctattggtacagcaatgccaagatttagaagttatttcataggagctgggacaaaggtcaaacctctctttgggcaagaccgtattctttattgcatagctttgaaaagagattttgtattacccaaacatttattttaaaaaggcacccccatatatccatcactcgaactgtacatttctaaatgtacattgacctttggtatattagtctagcaatccagattttgcctcttgttaagcgtatcagggtcctggcaggaagtagacgacacactgaaggataactgtcaaaagtttaatgaagagactatttacaaaggtgtgggcaaagttaaggggaacaacaagtaagagatggtgtagcatcttagacctagcaacagcagaaaataattgccactcctaactctgaagagataaggagagggaatacttagcagaacacagcaagattgattagtaaagcacagagctcctgacgaggagatgtgaccttcaggagaggaatactacccccaagctatggcccagcagggaaagagcataggtaatacattctctgactcccactttctgatttcctctagtagctccctttggccaaattcaactgattattagagagtaggaattccagttgctgcagtccatagaggttagtctcccnat

SEQ ID NO: 3651 - DNA, 776 bp, Homo sapiens
  misc_feature (1)...(776): n = A,T,C or G
gtactaatatntnaagntnctcgtnctttccnnacncancnnggcggnggcgaattcggcacgagatgttttgggaaatagcttgtgagaggtaagaaggattgcaaagtttttccaaaatattttatgaagttagtgaagtcagttgaaatgtgtatttaaacatttgaagggatacagttaacatttttttaatgagaggaaaccattgtctgtagttcagaaataagatggagtgttttacttatttaaggggtaatttaaaaagtaaacaaaagcattggcctacaagagaaaggtgatgttggattataagtgctttttctaatcgttaatattaatcaacaggtgagtatattttccgtttccaagcagttattaatttacattttctcaaattataagtagcttcctgcttctccaaaagtgaggcttaagaggatggctatttcatcataaattagaaaaacgactacaaatatgaaatggttaattttttggtactaagataatgagaccatccagaattttatgatcaaaacatggcttttacccagggagtatctgtagttgagccactggctctataacattgttagttctttgtattttcccaatggaggttttacctcatggccataaaaataaaagagggttgaatgtgaaaataactgcattttgaacatctcanacccttcactcataaaaattacttaatgttcctcttccttgaattacatatttttccattgtaataaaattcctgttttgaaann

SEQ ID NO: 3652 - DNA, 846 bp, Homo sapiens
  misc_feature (1)...(846): n = A,T,C or G
naactaatnaccangaccncnanntngcctaaanaaaaggctngggggattcggcacgagggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaatttctgcacttaacacaattatcacagggtcctgaggcgacatacgtcctcctcggcttacgagatgacaggattaanagattaaaacaggcatangaaatcacaagggtattgattggggaagtgataagtgtccatgaaatcttcacaatttatgnttagagattgcantaaagacaggcntaagaaattataaaagtattaaatttggggaactaataaaatgtccntgaaatcttaaaaaanactantcacactccncccncaactnannccccacnctccnntnccntcncnccnaccctnnnactcnctcctctccncntnnaccccttcccccnnntcntccctncttctcntcnnctncnctctcctncnctcatncccctcactccttctnnncctttcatntcntcancnanntcnncctcnntnttcntncnctctaccntnnccatnncnatnnctcnntntnccttctctcct

SEQ ID NO: 3653 - DNA, 782 bp, Homo sapiens
  misc_feature (1)...(782): n = A,T,C or G
acctattantntgatgtcganntnncctaaananataggctggggcgaattcggcacgaggcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctctcaattatccacagagtatattgttagtgttttgtttaagctaccttttacactcaattaaaactatttactggaagtaggctaaggtnatggggtgagaatagagatggtattatatcatgaaatctacggaagagtttgtagtcntagttcccctgcccccacagagcttattactcttgaagaagctttgacnaattctacatgacttattccccctactttaacaagacctgctatactaaaactataccncagtttttccaagagaatantgcttctaaattatattanctctggntcccatatannctnnancattnctccctttctcttattcnaaagttagnttntnattangactcttntgancatatnnnnttannntncgnncncccgnatantcnggttccctntgggct

SEQ ID NO: 3654 - DNA, 781 bp, Homo sapiens
  misc_feature (1)...(781): n = A,T,C or G
gtacctatcgtntcgtgcatgtcgnantngcctaactanaattggttngggcggaagagctgaagagtaggaggtggcaggactaactaaaagtgggacagtcacttgttatagtgaaggtagaatggacagaattgggcaactaattaagagggagaaccctctaggagaacaggagaacgcatccaaacctggaaaaccaggaagagaagatccttggtgagaagcagtcaatgagtttgctttgggatatgttgagttcccaaactcatcatgaggtgaggcttccaggtagcaaatgaatcacttgagaccaggagttgaggagcagcctggacaacatagcaagaccccatctctacaaaaaaaaaagattttaaattagccaggtgtggtggtatgtgcctgtagcccaagctacttaggaggctgaggcaggaagatcacttgaacccagaaatttgaggctgcaggtgagctatgatcacaccatagcactccagcctggataacagggtaaaaccctgtctcttaaaacanacaaacaaacaaaaaaccaccaaaatccttatgtatctggtactatagttgtctttctcattttacatttgacactgagagacagagaggttgangagtttgggcangacacacagctnatacatggtagagtcaagccttgagttcangtctnctggccccttatttccaccccgaactttcaccattatcatattgtcnggnangcttggagactcttgaatccctttaactcacccct

SEQ ID NO: 3655 - DNA, 1017 bp, Homo sapiens
  misc_feature (1)...(1017): n = A,T,C or G
gaactaatncctcncnnngtctaantngccnaacnngntngngttnggggnattgngtaatanantggcagntaccaaagatggntgtctnnagttnctaaatgacatgttgatcggngtcatgatatctgcaaatantcttgtctttcttnacctnagaacaaatgtnaagcattgatnggagcanacacaacagttacgaantntnctgcntggcaactgactnaaagcnaatntactantcctcttaaacttccaaaanagtatncantactacnggatggntctctatncacangcncttngtctgtnacntcnannatntcacntatctaanaanananntcnnaatgatnaatctcaacnaccnccaanannaagttnncgnaccgtgnnagtngtncancntaanttgancgncacttgcctttnctntccccaggcanacgaatattnctccctttttaagcccntccanggcncaacggctcctncnntccncanatcgcaaagnttaannannncntcctnccctcttcaattantcactaccttcaaactcnctcancncattnccgnccctccntctcngcntcacctcgtcacccnntcttcctncaagtncnccctnntaanccnnacnntttcccnnnaacccctccncgnttcctnnactcactgnnctccattntctcccnctncccctncaaannnatnctccctcnntanttcccanctctnactccagccgctancacacntctcgctcacatctaatccnacgncattcactnctctccganatnancnatcgcgtntatangngaacctaannnctatctcacnctnnantctcnctaatnccancnntaanctntttgctncagcacanacacntctctctacactcncnatacnacttntanccatttncntantactccatctacanactctctcatnncaccacncatctctnatacaacncctctntctctctctngctancacancact

SEQ ID NO: 3656 - DNA, 908 bp, Homo sapiens
  misc_feature (1)...(908): n = A,T,C or G
ntaangnntgtactcgngntanctngcctaaatanananngttnggggngctgggtgtnggtggattacacgcgtgagccattgcacccagccttaagggaccaggactttatctttntaccctgctgtaccatctttagctttttatctttttattctcatgcttttgttncttcatgatgttaggatggctgccataactccagggnatacaccaatcctctaaacaagaaacaaggggntgagacaaaacactctgagaaggttntcngggaacaaaagacctccaagctgactctgcttnataactcattggctnaaactgagctatatgcccatacttanagcaatcactgacaaaggggaatagcaccaaaacacctctggcttatcntagatcaacctcgattnattnntctgggtttngggttggggccttcttnacctgngaagcaaagaacctcttgccagcttgtccacggctactcangttcnntntacccaacaannggctatngggttagtgactaacttnccacagcncngcanatacatttcgtatagtaacntntttccaagancttcntaanttcacccntngaactatccngcancanatnannnctnttnctanttnnatcannntggtntcaaactcananggnttttcannccaanntnnntntntctnacatnncccnnccctncaantccccnnccgtcntcactcntcntccacccctnnaccccttntcaanacctctacntnttcangctncncttnccnnntnntccctcatnanctcactcntcactntnctctccnncccnncantaccntctctnnncngtcctcctctctnnntccctctctctcancatatcttccttncncatctgtnnccncc

SEQ ID NO: 3657 - DNA, 848 bp, Homo sapiens
  misc_feature (1)...(848): n = A,T,C or G
aatcncngtacngngcgnantngcctaaananaaggttggggggccctctgcttcctggctgaccttggtgtggccctctgatggcactatgtgtcctcttctctgagctttctgaggatgacaagccgtcttttcaatgggactcccttccagacctgttggtctcaccatactggaatcatcataaagcctgtattgtaaaacatcattggtgnctaaagtttgcacaatgctatggcccccacattaagggagtctgggtgagatcactncattgcccctacttctctgaccanaaaacacaagagttcatgggagacaataataacaacaacaaaaacaatacaagaacacantngtacctcnttattggcacantaacttttcaaangctggcatgaatnaaaagnncccaagtcncaagacnaggtgnnctgganccactgctcagnactttccgacagccnacgaaagcacatcnaatgaacaangccttgcattantgggacgnttnnngatatacancccanggaatcatgcncctgttagtccanggggacnagccctntnccatgcncccnctantgctcaaaccnntcatnggcancttgctncatttcgtacnnnngtnggccccttnaatgaaatatcgaancaatttnttaaacccncccnggccttattgnnactttctnaaanncccatcncccttgncttcatannncntnnctcgcccttgnntgcaattctcccctngcnggacntctaatgcnntcaaaactcnancgcnnnnggtcncaacactttttanccntannacaggggnttagncccaanatttccnacc

SEQ ID NO: 3658 - DNA, 775 bp, Homo sapiens
  misc_feature (1)...(775): n = A,T,C or G
caatgcncnaaccaattantaagntactcgnnctttccgnacncancnagtgcggnggcgaattcggcacgaggctgagtatttttttcaagtgtatcatttgcctgttaacttaaaattctattttccccctaattctatgtcccagttttggttagtgtgctctgggatttttgacccattccatagtaatagttattactactaccactacagtaaattcttacaagaactttccatgttttttgggaggaggaggaggagtagttacattcaggatcatatacataattgtttagcttcagttctgtatttatatatgtcacttgtaactgactgggatacgttctgagaaatacattctcaggtaatttttgtcattgtgccaatatcatagagtgtacttataaaaacccaggctatatattataacctattctgggcttcaaacctgtacagcatgttactttactgaatactgttggcagttgtaacacaatgataagtatttgtgtatctaaacataccaaaatatagaaaaggtacagtaaaaataagtttaaaaaaaaggtacaccaaaataatcttatgggaccactgtgtatgtggtttgatgtcattatgcagtgcatgactgtactataaatgcttatggccagccctttttttttttgaggcagagtcttgatgtctcgcccatgctgggagtncnnnnnnnnnnnnnnncnnnnnnnnnnnnnncnntnnnnnnnnnnnncnnncncnnnnnnnnncc

SEQ ID NO: 3659 - DNA, 778 bp, Homo sapiens
  misc_feature (1)...(778): n = A,T,C or G
aantnctnnaacttatnntntntngacctcganctnncctaannagnnnggntngggcgaattcggcacgagataaaggcctagtttttgtatcccaatagatttttaccaagcttcccctgaagaaagtttagaatgagcatgatgggaaaagggagaaattgtatgctgcagatagagggaggaaaggccaactaggtccaacaagtaaaaagaggactagtctcaaactattaaatatatgatttacctagcaaaagctttaagtcacagctgaattacactggggaaacaattacagactttacaatggaaagaagcatcttcaatgttggctgcaatcactgacagcaggaatactcacttttgaaaaaaaaaattggctattgttttctgttttccacatcttagtttaatattatgttcctcaaacactatgaagttgagaactgaattgattacctgggaaattctggtgaaactgaggtgtttgtttcattaattatccatgtcatttatcttcttaacttaatcaacctaaatttagcctgaatattatttgttagggactgaagacttctagagagcagagagcacctttttttaattaaacaaattcctttgataatattttaatgtgactcaagaatccagcactatctatatatggacccctctgcatccatgaaaagaagtcctcatccaattctgtgaatatgagactaaaatacaattccaattatgaggnattttnttttaagtcctaatgcaggaagaa

SEQ ID NO: 3660 - DNA, 792 bp, Homo sapiens
  misc_feature (1)...(792): n = A,T,C or G
ctaacttatntntctaganctcganntngcctaaananctaggncngggcgaattcggcacgagcactacatgaagtccggggtttggttaaaatatctgtcttatttatgaaaggctgaaaagagaaaagagctattcactacccgagactataagttttagctgataaaaacacagcctcatcaatagctattgaatgaagccacttgctgagtcagtaactgaatgtctatgtatgatatttccagtatcatgattaaaatggagccccgaaatgtcattataaggcctagttgtggactgggggcccagatggccaagtgggagcaactctgaaaccattaaataggaggagagagagaaattaaaaaccttttctattcaaaagaaacctataacccaaattctaaaatttatagagacatataatattaatataacaaaatcagccaccaaaacattcatttctctggatgaaattaattttatggagcagttcaacaaagactttattttaaaaaataaattatgtatttatttttgactagtaatagatgcatgtagtacaaaattcaaaggtacaaaaagggtaaacagtgaaaagtaagtctatctccacctctttcacctagccacccagtttccctncccaaaggcaaccactgttacccatttcttgctatcccttcctaaggataaattggttgcattattccaaacattatntantatatacaccacaccacacnactcaccacatatggtaccatttttttattattcaaatggnn

SEQ ID NO: 3661 - DNA, 779 bp, Homo sapiens
  misc_feature (1)...(779): n = A,T,C or G
ctaatnctgnacnaatnggntnngctactcgtnctttccgnaanancnaggcggtgcgaattcggcacgaggtgggctctcccttaaagacacatggccacagacacctccttcgcatatgtaatatgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaatattcccaacacaaagaaaagataagcgaggtgaaggaaatcccagttaccctcattcagtccattacacattcgatacaggtatcaaaatatcataggcacctcaaagacatgtacaactcttaatttaacatttttgaaagaaaaaaaaaccggccagagcattaaaacaaataaaataagaaacacagaggccagtgttaggtgaagaactccgctgcttcagaaagagaatagcagcgctcgcttaccgtgggaacacggccagttaacaaaatgggttttggttttttgntttgttttgttttaccattggtaataagatagttaacataagtggtcagaacttcgcttgaatttgtataaagcatttgttaagcgtgtaaaagtccaaattaaaagtcttgaa

SEQ ID NO: 3662 - DNA, 805 bp, Homo sapiens
  misc_feature (1)...(805): n = A,T,C or G
aatnctnaacttattatctgacgtcnanntngcctaaanagaatnggttnggggaattcggcagctccctcaaagaaaggagaactaggaaaatgttttcgccatctcccaaagatgataggaaagttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagananagaaagatacactgtgaaggatantcaaaagacattgcananaggaggactggtactgtcccccacccccactaagagcttaagatanaacagcctgnatgagactatgaaatatntttaanntgatgaaagaaaaatgtcacctntccttctttcccagtcaagacangnngnatcccntttgnntaancctanaaantacctgtgtnagatactnnnnttgatcgtgagacgccnatagtcaaacctcttggangnaaaactanacattcttcnatnctttnaanttcccccccccntcnggcccctgtcttcccanattcacctaacttccccttggttgccccccacttaattcnacngcccnttnttttttcactccaaacngggncct

SEQ ID NO: 3663 - DNA, 773 bp, Homo sapiens
  misc_feature (1)...(773): n = A,T,C or G
tnnctaaccaatnantcnaggcanctcgnnctntccnaaataaanaggntntggcgaattcggcacgagaaatgctgaatattggtaacaagcaacaggggaaacaaggcagtctgagcacacagaactcaagtcctcctaatgggatcccagaatgcccatggaggaagcagcatgtgcactgtgctgagtgctgagcaggatttcaagagagcaaaggcagagatgctggacagggcagcacaggaggacgagtgtgcatggtcactctgagcagggctggttcctgggctggttggagcacagcatggggaactgaaaggcagacactggccaagaaagtccttgtgcagggcttcagaagtgagcctcacaagccatcctaggccacactgccatcaagccccagacctctacatgcccatttggtttctttccagctcatatagcttcctaagtattgtggctaacagttccctgacttgaattcctagtttctgttaacagttttctaactttcaggaaaaacaagccaatttctaaggaaagtggctgtgcttcagtcaggagtagtccgaggtagacatccaggacagtatgacgcaaagggtttggagcgcaacaaccccttgcgttatatagccatttaatgtaacctgtttgtgtgagttcatacctggctttgagccactattgtctgtgagtaatataactgcactgctgactctgtaggagagagaataaagccatgtccaacttgcctacagtcctcn

SEQ ID NO: 3664 - DNA, 777 bp, Homo sapiens
  misc_feature (1)...(777): n = A,T,C or G
taatgctnggctctcgttctttntgcaggatccctcgattcgaattcggcacgagtatagatccagattctattcaaagtgccttattagcatcaggtcttggatcaaaacgacctagttnttcatctacaccagttntcttcacctgctcctaacangtacaccagctancagtcncaccnacngtaacagtggccttntnacnggtaangatgctgtgtgaaagggctcagcaagatgacgaaagacctgctngataagctcnagnaattngcngaanacctgccncctnataccntnnatgancttanngannaacnnggnggnnctnctaacgtggntgagatgactggccgctgggacggtgttgnnanctgcgatgatggacgcatgtancctnatncangntntgnactnnangngcctgtggaanntcncgangttacncgtgctcagggatattatngatggcgnttacnntantgctggnatccatcatgctggngaancnggtatnacattacatctgntnngagagcttgccatnataggcgangntttcatatgactttgggaantgnccttgatccgctacntagancngctntaacagttggggaccctnnntganatcancncaggttcctgtggnggagattncctacntgaanatgggcnctgncggagctaacggaanatcngngtancnttgctgctangccacttnanaggattgtgggcactttcacatggngnntnaacgcttggcaaacttcn

SEQ ID NO: 3665 - DNA, 815 bp, Homo sapiens
  misc_feature (1)...(815): n = A,T,C or G
gtacttatttntaatgntggtcganttggcctaaananaataggttngggggaattcggcacgagggttgccagcatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttantgaggttcagccacatgcctagacttatatactagttagtggtgcagccagggagaggactcagatttcctggaggcaaagtctatctctgaaactccatgaagacttttgcagccagttcccaccaatatgcccccagacgtgagacaaacaaggactttttttttatatagagccatccatnaaaatcctaagccccttttattaatgtataaccaggaagaaacattttgtgccaaccggtttggacttttntatggcntgagaattcgggnaaggaagtgttgacccccaagccanggagaaggaaagaantggantttncntttgtcctttaagggttttntaangnncattggtttttaaatcncgnnatcnnngcccaaaanttnnnttct

SEQ ID NO: 3666 - DNA, 774 bp, Homo sapiens
  misc_feature (1)...(774): n = A,T,C or G
ttcaaatccnagctcttgttcttttgcggatccctcgattcggaaggctacaagtgacaaggaaaattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaactggcctggaaggctacaagtgtcaagaaagattctgtttcgaatatagccacagagataaaggatggacaaatacgtgggacagtgtcttctcagagacaaccagccttgaaggctacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggttggaaatctggaacagagtatcctgagaatctgcccaccttgaaggctacaattgaaaataaaaattctgttctgaatacagccaccaaaatgaaagatgtacaaacattcacaccagcagaacaagacttagaaatggcatcaganggagagcaaaagangcttgaagaatatgaaaataccagccacaggtgaaaaaccaaattcattctagggatgaccttgatgacataattcagtcatttcaacagtcttcagangat

SEQ ID NO: 3667 - DNA, 733 bp, Homo sapiens
  misc_feature (1)...(733): n = A,T,C or G
ttnctaatncnagctcttgttctttttgcggatccctcgattcgaattcggcacgaggntgnanaaagnatcngctggcnanntctatcatgnatcagctaaggatttgccaacngaatnntnctcnatccttcantcatgacacntcacatgtcaagngnagaaggtacancgtgnaaatgctatanccggcnnaatntaggagttcttctctggctcggttgctaaagcagtgatctgngtnanccccagggccatcactgtgcatgtncccatgccctnaacngnattcgagcacatactgattnactanaaggaggngnangnccagcagnaacancnnacgatgacattggccnnganctaccncntgnncgatgggaaaatggtgaanntncnncgcatccngaatgcgcnagttnntgtaactcantaccaantgctcagcagcactctcttctctngctcgtggagcttcagcccatnantggaatanaacatcngctnagantncactngncttttggattgnattgtncaatccttggtgatcacaatnnctcagactggaataggctgccccccaaaactgtctgtggcaccctgaaaaagctggggctaaacagncaaggccgntcatccccttgnctgaccncgnattgtctgctgctgggttcggacgaggactactnngntgaantnctccttgttggcatgatgacnctngttaaga

SEQ ID NO: 3668 - DNA, 774 bp, Homo sapiens
  misc_feature (1)...(774): n = A,T,C or G
ttctaatnctggctctcgttcttttgcggatccctcgattcgaatgcggcncgaggtgaaccttccccagtcctatcagagcanactttctggggttgcatcccntcagaaaccnatttggggcccaatctcaatgcacatatcantgcgcanagcnctaaaatttcaggcaacactttgnttgagagangccaaaattttggncaggccctgggacatctaaagtcaccaatgtaactacaccatacagattaaaccctcacatgatcatgtaagctatgcagttacccaagctgcatcatttanaaaacctgtcagntnttatggaaaccatccctagtcaaggacactttaaatatntagtctaaataccgttaangtaggcccactagctgtgttcacattatcccttggccaccttaccagggactnnaataacttgggaaagtgaaaacaacaagctnacccacatgttcaccatnnaaancanttangtcttgaaaaacatggactctttttnccgtgtgggaccagttcctacttatgtgttaccagccaattggactggaacctatacagntgggnnatntagcccccgaaattaatatagctcccaacaaccaatccttcattatactttnaactgnnaaccaccanacacaaatganccatccaactgataccactttcngtngaagctanggaatacncctngaagtctgantgagagtttcagnccttgcngctnncctatcctattaccannggttgnct

SEQ ID NO: 3669 - DNA, 779 bp, Homo sapiens
  misc_feature (1)...(779): n = A,T,C or G
ttnctaaatncnagctactcgttcttttgcaggatccctcgattcgaattcggcacgagatatgcacattgtnccaatggcagacttttggctttgatattgttctataattatgtaagatgttaccattatgggaaactggaggaagggcatatgggacttctttgtactgctttttctattccctgtgagtttataattattttataataaaagttcaaaaacacttattggatggacatcacagaacataatagaagaaagaatcagtgaattataggtctgtttaatagaaatgactcaaactgacacacaaagcaaaaagaatgaagaaaacagaacacagtgtctgagactttgtggaataatattatataaaattatctaacagtcacatgatttgaccctcagaaggagatgaaagaatgagatagaaggaatatttgaaggaataattgttgaaaatgtttccaaattgatgataatgtcagctcacattcccaagaatcacattgaaccctgaccaagataaaccaaagaggactacatctaggctcatcatagtcaaactgcttaaaatcaaaactaaagagaaaaatcctaaaagcaattagagaaatcctatatagtccatgttgggaaacagttacatcaatgtgtgctgacttctcatttgaaaccatagatgccattagacagtggaacaatatttttaaagtgttcaaaggaaaaaaattgctatnccagaattctggatttgcccaaaaatctcttcaaat

SEQ ID NO: 3670 - DNA, 814 bp, Homo sapiens
  misc_feature (1)...(814): n = A,T,C or G
ttncnaaatacctngctctnggttctttttgcaggatcccttcgattcgaattcggcacgaggcggatcaacctggcggaggacgtgctggcctgggagcacgagcgcttcgncatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctatgaccagctgaagcaagtgatgaatgcgtacagagtcaagccggccgtctttgacctgctcctggctgttggcattgctgcctacctcggcatggcctacgtggcttgtccagcactttcaacctcctctacaagaccgtccagaggctgctcgtgaaaggccaaagacacaagtgaccacaagccaacccccaacaagcccggnagccccccggccggtttcaacaagtccccttgggggcccgangcaccgaattgaaattgggacaacttggccccgnccgcggggcnggncccttgcaangggacca

SEQ ID NO: 3671 - DNA, 775 bp, Homo sapiens
  misc_feature (1)...(775): n = A,T,C or G
ttccnaataaccagctacttggtgctttttgcaggatcctttgaatnccctttncngcacccagagtcattgagagtctgtnccaaaagctacatgaaggccatgggaaaaacccgggtgccattttttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctaccctctgtttttgtttgatgaattctgttataacctatggggtcaggatatgagtcctgggcattatttatccaggacccatcctcttgggtgggttttgggtgttggctgggtaaaggggagccggggacttctgaaataanctggcttcctggggtgacaatgnatatatgcaaataaattgagaaatcttttaaaaaaaaaaaaaaaaaaaaa

SEQ ID NO: 3672 - DNA, 769 bp, Homo sapiens
  misc_feature (1)...(769): n = A,T,C or G
ttccnaatgctggctctcgnncttttgcaggaccctcgattcgggaaaattccagtttatacctgtggtncctgtgtaattatnggtagcactccctttcactcttacaangtctnggtttggatgatatatggtgaagtttttgttgaaactaaattatgaagtctgatatatttggataaaaataaagaattgcttttcttctccttttgctgattttttgacacatcattctaagcaaaatcatctcagcttcgtatatttcagcctgaagtacttcttaccaaagttgtttcatgtaacatttgttcaatatgttcgtgacatgtctctcagtaatgaaaagttatgcattttattgaatgaataaaaacctaacctctgctatttccatttctggaagttgtaagagctcacattaaagacagtaaaagtcaatttaagccaagatcattttcagcccaccaatgtcatggctattggaaaggaaaacctaatgtgatcattgaactatcataacaagtggaaactagaacttttttatagcattttcatgatataggtcctgttatagtaagatatttcattctatttatcaaaatggtgtaaataaaagaaacacaattattttggtaatgcttatcttcagtttaaacatttattcttttcagaaatatgtaaataccctttgnaaatatatnccaaatgaaaaataagggatattttacccattaattatttctggaaagatcttatgctggtttaaatt

SEQ ID NO: 3673 - DNA, 785 bp, Homo sapiens
  misc_feature (1)...(785): n = A,T,C or G
ttncnaannnccaggctactngttctttttgcaggatccctcgattcgaattcggcacgaggtcctggctactgaggaggctgatgcaggagaatcatttgaacccaggaggtcaaggctgcagtgagctatgattgcaccactgcaatccagcctggacaacacagtgagaccctgcctcacaaaaattatattctgattttctgagtccatgaacacattgtccaaatggatttttctagctcctccaagttacagatagttccacgcacacacagaactcaccactctcaaatattttccccactagtattactattaaatttttcaaacatgcaaaagatgaaagaattgctcagtgaacaccatgtacccaccacctagattctacaattaacattttaccctactttctttatcacatatatgtacctatccatctatccattcttccatgaatccatcaattcatctaattttttatatatttcaagttaagttgcagatatgtagcttatgtttcaccttaaatgtttctgcctggctattattaactggagtgcaatatgtttttggttcttctttatggtaaaatctatgttcagtgaaatgcacaagacttaggtatgccattaataggttttggacgaatagacaaaccttgngtctgaaactggaantaaaaaaaatcaaacactaaaaaaaaaaaaaaaaaaaacttcgagcctntanaactattngngagtcgtattaccgtagatcccagacatgataaggatccattg

SEQ ID NO: 3674 - DNA, 763 bp, Homo sapiens
  misc_feature (1)...(763): n = A,T,C or G
ttcaaatcncagctcttgttctttttgcaggatccctcgattcgaattcggcacgaggtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagnttacagctcctggatgaaagagcatggaggatctatcgtaatatcattgtccctactaaagctggatttccattagctgtgcattctggagctgcaagagcaggtgtttacaacctcaccaaatctttagctttggaatgggcctgcagtggaatacggatcaattgtgntgcccctggagtnattnattcccagactgctgtggatnaactatggttcctggggacaaacttcttnnaagggncttttcacaaaatcnccgattaacgaattggtgttcctgaggaggtntcctctgaggtctgnttcctactgtctactgcnccttcttnattctggacagtcagngcntgtngatgggggccnganctctatacccactcgtatgaggttccaaatcttgacnctgcnccaangttccaggggaccntnttgncggtgaaaananatgnaagnggacttttnaaggngaanagctaancttcnaacctctggnaant

SEQ ID NO: 3675 - DNA, 772 bp, Homo sapiens
  misc_feature (1)...(772): n = A,T,C or G
annccagttctngttctttttgcaggatccctcgattcgaattcggcacgagacaggttcccatagctacagaggtgcttttcaaacttacncagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagatgtcaaaatacctgtacaattttaaaatgtcacaattaaacatgagctggtttcccacacaaaanaaagactgaagatntgcattttaaggatgacaacataatgganaaaattngaaatagcatannnaaaanctnggcccnttaacanatgnggnttgnnttgcccgaaatcccgnnnnggttanaccccttggatantttgggcaacncccnanttgtntgccntnnanaaaaaagccntttnttttggaanaatttgggaancntttgggttttattttggacccccttttaancnccannaaaananntttaancccccnattggnttnnttttngntttnagggttangggggng

SEQ ID NO: 3676 - DNA, 775 bp, Homo sapiens
  misc_feature (1)...(775): n = A,T,C or G
ggnnnttgcnaatncnatttgacccnttgcngcaggctccctcgattcgctcaagcaaagttcctgtagacaaagtaacaccaagtactcttccagaagatttctagannttgaaaaattccttcagcanacaggntggcgacaaggngccngggatgannangagcaccactaactccctnaggtgctanacacacataatgggaagccaacatttatggaagaagttctagaacaccttcctggaaaaacacangatgaagtcaacagcatgaaaantggtatcaaaagttctggctctagaagaaagaaanncagagtcaattnanatntggnaaactnnaaagcagcncaanngggaggaaatttccaagtcaaaggaannggctgacaacacacctgtgcttatntcatancnnacangaggattancaanngcaancagaggaacantgatgagactcaganatnggcatgttgaagctaggaagaaacagaanagnntagaantgtcaatgaaatgngcttccccattnaaanacgaagangagaaagngananaacatgacaaagancgccagngccagtttangttnaaantactactngaaagttntacccagcnacatgaaagaacaggaagaatttttgaggcttgaaaaggagataaagggaaaaggcagaaaaggcataaaaaaggaaaaagctgctgatgaaacttccagatttcaggaaagagttgaaaacaatgttagtcgagatccctctaggcttn

SEQ ID NO: 3677 - DNA, 759 bp, Homo sapiens
  misc_feature (1)...(759): n = A,T,C or G
cagctnctngttctnnttgagaccnctcnatacgactncngcncgaggggattngaatgcccatgaaagacattttattttacttgaatatattcttgcttcactttaccctccataatatgttgtcattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtcttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcangcgcctgtaatcccagctactcgggangctgangcaggagaatcacttgacccaangggcagaagctgcagttagnccaagatcgcatcatttgcactccagcctangggacaaagacgcgagacttcatctcaaaaaaaaaaannttnnccnnnntnnnnaaa

SEQ ID NO: 3678 - DNA, 762 bp, Homo sapiens
  misc_feature (1)...(762): n = A,T,C or G
aaaaaancagctacttgttctttttgcaggatcccatcgattcgaattcggcacgagctggaaggggcagagcccaggacagggctccatgtccacaggacggcgaggagcgaagaccatggggactgagtacacagatgaagacacagaagcatagagaggataagtaatcactagcaagtggaagaaccgggattcagatccagaacaggctgactccagagtcactggctgtcatgtagtttcctcaactactgcctcagctctacaatcccagagtaaagctcttctccaaatgaagagccaggaagaggtagaggtggcaggaattaaactttgtaaagccatgtccctgggttcagtgactttcacagatgtggccatagacttttcccaagatgaatgggagtggctgaatcttgctcagagaagtttgtacaagaaggtgatgttagaaaactacaggaacctagtttcagtgggtctttgcatttctaaaccagatgtgatctccttactggagcaagagaaagacccttgggtgataaaaggagggatgaacagaggcctgtgcccagatatcctgaaaatgcccatcagtaagttgaacaagaagaacgggagctttaagaacaagattcaagatgaaacaacacaagtgttgaatattttataaatagctaaaggcagaaaacgttgccaattatctcagacttncagaagtgaaaacaaacaaacaaacaactnaagtcttaattgaat

SEQ ID NO: 3679 - DNA, 788 bp, Homo sapiens
  misc_feature (1)...(788): n = A,T,C or G
aaannccnggctactngttctttntgcaggatccctccaaatgcttggggcacgagggttcagagaaaagtaggcagagaaaggcagtttaggaggtgacacaagagggaagcctaaggagagagaactggatggagcttcccaggtgatgacagggttgaactccagggctatacccagctgagcaaggagagctttgcctcttcaggagactggaagttggggaagactccaacaggcttgtggtcagaagctcaggagactgggaaggaaaagtgaatttctgaggagtcctagttcatttcattaatttgttcaattctttaacgtatgtttattatggacctactatgttgccagacgctgtgctagctgttagggacacaatgatgaacaaaataggcatagttttttaccccatgagagttagagggtggtggggagagtcattaatcaaatggcacaaacacatgtaaaattaccataaagcgggtgatacagaaaggcgactggtgttaggatagctaaaaaagagggatttcacctggtcaggtgggtcagggaaagcttcttagagaaagagggactttgggcttgatgaatgaaaggtgaatttccaggcaaagaagaaaagggaggangcttctaggcagaaggaacttcctgtgccatgatctctgagaaatgaaagattaacaaaggccaattgtaagtngaaccagaattgaacccaggaangccccaaanttgagaanaaaaaggcccagggcaagggccattncntggnt

SEQ ID NO: 3680 - DNA, 763 bp, Homo sapiens
  misc_feature (1)...(763): n = A,T,C or G
ttcnaatgctagttctcgnctttctgcaggatccctcgattcgcacctaacattaggtggcacttaatagtgatgataatcacttatggagtctactaagatgttttgaatcccttctcccattcaaaaatcttgncaaccctgtgagacagatatgctcaccttactgatgagtacggnggcttggcaaagtaggtatgttgnacatnttacacagctngtnactgnaagantcnntntcatatactcccagattcagaactttaaataaccccatgctaccttctagggaaagcttctgctatgtgtttggagggtnaggtgaganaaaggngaatnntaatctnccaacatgctcactcctttttcctgctctgtgggggatgtaagtgaataaccccagtgctgtggtgcactcgttaatcttgtagcantgacangtggaatgtgggtctgcaggtggccttggtatggtggggataactatgtgccttcacctgtccctacacaggcatacctaccagcttgcgtttgctttcgacatgtntgggcaagngtgaattgcctctgctnctctggagagatgggccctgtggctgctntgggaagaacatcaaattttgcgtncatttacatatggcatnctgtgnntntggaatctatgcatntngtgttccctggcttcaaagttngtaacnnatgtggtnagagccaaaacccctacttgtgtaccaaaggaaggngcttanggaanaatggcttt

SEQ ID NO: 3681 - DNA, 770 bp, Homo sapiens
  misc_feature (1)...(770): n = A,T,C or G
ttctaatgcttggctctcgntctntctgcaggatcccatcgattcgaattcggcacgagagagaactagtctcgagtttttgacagataatagccaccctaggaggtgtgaagtggtatctcattgtggttttccatttttctgatgactgagaatgttgagcatctttccctgcgtgttgtccatttgtgtatcttctttagagaaatatctgcttacgtcctttgcccagttttaattggattgtctttctgttgctgagttgtcggaattggttgtacatcctccatactgagtcctcatcagatacctgatttgcgaatattttcttccataccatgagttatcttttcactttcttaatggtatcctttaaagccccaaagtttttaattttgataaagtccaatttatctaaaaaaaaaaaantaaaacnnananaaatnnaaaanaaaaaaanctngnncctttaaanctntagngngtcgtttncgtaaatccnnncntgataanatccatggntnanttngnacaaaccacaattnganngcagggaaaaaanngctttnttngngaaattngnnanctnttnncttaatttganccatttataagctgcnantaancangttaccancnccaattgctttcatttaangttnaaggttcaaggggnaggttnnggangttttnaantncggggccgagggcncnaaatgcattgggcccggncccaantttngncccnttnanngngggntaaattgccg

SEQ ID NO: 3682 - DNA, 775 bp, Homo sapiens
  misc_feature (1)...(775): n = A,T,C or G
ccnngntttcnaaatnccagctctngttctttttgcaggatcccatcgattcgaattcggcacgagaggtgttgaaattacagaagggaccatttctggcaacacagcagaccagatatcctataaaagtcttccattacagaacacctacacatcaggagctcaaaaacagatatattctttaaatgtctagccaacattttggaaaagtgtgggaaatccctcagggccaaaaccagagggagttggacaccagagtgataagcagacactgaaggcaaggccaacctcagggcttggctcaatattctagaactttacccttgttctcaagtctccgtgtggacaggggatgagggttacctggtttctgctcctttgactatggcatagactctgtagatgtctgtaattgaccgggaggtatgtagatgactgtatcaagttatcctcctgaccgggcgcagtggttcatgcctgtaatcccagcactttgggaggtcaagacaaggaaggaggtgagctgacagatgtgctggaagagcacaaggaacccaccagtcaggcatgatctcggagagggcgcttgtttgggggttactcagtgagacctgggaagganagaagggaccttttctgcangacggtggcctggagaagaagctctttttccactgaaacaggaggaatggcggggaaggatgaatggatatgtgtattaattatctattgctgcatgacaaatacggatcactcaagtccaggagtttgagat

SEQ ID NO: 3683 - DNA, 774 bp, Homo sapiens
  misc_feature (1)...(774): n = A,T,C or G
ttccaaataccatttnangccttnttgcaggctcccatcgattcgaattcggcacgaggccatgttggccaggttggtcttgaacttntgacctcanttgatctgcctgcttcggcctcccagagtgctgggattacaggtgtaaactactgctcctgncctgnaatccattttatnatgggaagcacanttacntagctaatacttgggggcangagctnaagtnannattgcatcnncantaatnnttagaatgaatatanattgaagtcttggggtatcccggcatgattatgtcagatgaaattatgtgatatgcanaaggaaggcctcctgcacttcatgnctncagctnantnctacananggncaagggncnatgannaatnnggangagggntncttgantngaatanatnatntntcactcagnttaaagcctgtaatcccancactttgggaaggccgaggcaggaggatcacctgaggtcaggagtttgagaccagcttggccaacatggcgaaaccatctctactaaaagtncaaaaattatctgggtgtggtggtgggcacctgtaatcacagctactcaagtactgangcagaagaatcanttgaacccaggangcanangttgcantgaacccgagatcacaccactgnactccancctgggtgaccaagaatgaaactcccgtctcaaaaaaaanannnnnaaaaaacttcgaaccttttagaactntnnttgagtcntntttccntnnaaccnnanc

SEQ ID NO: 3684 - DNA, 755 bp, Homo sapiens
  misc_feature (1)...(755): n = A,T,C or G
atccnagntactcgctctttttgcaggatcccatcgattcgaattcggcacgagggaagctccaggcctggcgtgctggagtcacgagatgagctgtccaggctncatggcatcgtgagtgaactccgaccgtggcaggtgaggcttctgcacttagctggctgtcttcatgtgggccgattctgtggttagtgattctgatttctcatctgaaaagtggtgcatcacttagcccctcccacacttggagggttctactagtgtgcctgcgtggctgggttctgcacactcagctactttagtttctttagtctatccttaaaaagattcctaggtgtgttcctgattttgaggttccgtttggtcattatgctctttcagagttcatcttttaaaatcagtctgtggacattttttttttcctcttagcacagtttatggtctcatgcaggtcaacaaattgggactctgaatgtgagtgtgtgtgtccacacaccactagggcttattaccttattgtcaatgttatcttaagaaaaagtggaggctgggtgcagtggctcatgcctgtaatcccagcactctcagaggctgagatggaaggatgcttgagcccagnagtttgagaccagcctgagcaacaaagcaagactcctgcctntacaaaaaaaaaaaaaaaaaactcgagcctttanactatagtgagtcggatttacgtagaatccagacatgatagatccattgatgagtttggg

SEQ ID NO: 3685 - DNA, 889 bp, Homo sapiens
  misc_feature (1)...(889): n = A,T,C or G
gctgggctacttgttctttttgcaggatcccatcgattcgaattcggcacgaggtttaatctctttaactatcaaattgcaattttttttttgccttgcaaataaacaaattacaattgtcatttactggtgagacaatgagaaaaagacaccctcaaacactgttggtagaacacaaattgttaaaatctttctaggagtcattttcaaattatgtatcaatgacctaaaaatatttatgtctcctgttcttatacttccagaaatctattctacagtaataaccggagataaaaacctttacatataaacatgatttattatactgaaaagtcaaaacaacataaatattaaaaataggaggtggnanatttcacctttaaatgctatgtaggagaatacttaagggattggtnaagnccaatagttttngtattangtggaaaatgccngaatggcatgaatgntgtacaaananagcnntcatnnnttgccactcttngtcataaccncntcgctcttcnatgcatnccccattattacaaactgttcncnnanactcnncnttcaccangnctccngcnnntncnannncgancntctncctccncancnnncccccgctcnctcnttctcnncaacctngctcnccccncacncccnactccccccncnttactttnncccaccnatccncgncacnnctntncttcnnncatnntnccccnncctactcnccnnntagcnctccncnttcccacacttnnctcnnntctgnnccntccnttcntctcncttactacataaccnncnctcttctcatctctctcttctctctcacnnaccccatccncnncnnnctcttcctctcttannctctcactancct

SEQ ID NO: 3686 - DNA, 763 bp, Homo sapiens
  misc_feature (1)...(763): n = A,T,C or G
gaccaattatatgacanttaccagcgaacnanaaggctgggcgaaaanatcaaaccatcctttgctggcattaaatattcaagttgaagatccttcaccttcctttaatcctatattagagtctataggtgtgtctttcttatagcaatcctgcactcacataaaaactgtattttcaatataagatcaaaatgtatttcacaaaaaatgcatctttatatttgtttacatttctcctgactgaatggtgccatgtacagtctgtgtaagttatagaaaacgtttgccaactcgtagtctaccattttgttatttgttttctatttgtttcgtctgttctttactgctttgttttccctttcctgccttcttctggattaattgagtattttggtaatcctttttaatctcctcttttggattttttagctatacttacctgtttttgtttttgttttttaaggcgttggtaggaaataatgtatgcatccttaccttattaaagtctattttgaaatactgttacactgcttcatgtaacttacaatatgaacctcacaacagtatagttcattttcccatcccagtatattttacttctttgttataaaccccatctctactaaaaatacaaaaattaactgggtgccagtggtgcgcatgcctgtagtcccactacnttgggangctgangcaggagaattgcttgaaccctgngaggcnnangttgcagtgagtcnagacgcnccactgcactccaccc

SEQ ID NO: 3687 - DNA, 829 bp, Homo sapiens
  misc_feature (1)...(829): n = A,T,C or G
gcntattantgtgncttattantgtggcctaaananataggctggggcgaattcggnacgagcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattntagttaagaaccggggagtactcagacattcaaactataccctccctttggaagaaagcatgctctactctatttctcgagacagtgacattttatttacccttcctaacctctccaaaaaananagtgttagttcactgcaaaccactanccannatcttatcacgaatgtggaaaccactgtngatgaagatgttntacctggcaagttaccngaaacctcctctcagagcananccgccatcttcatataangcnangtgntaattggatgggaanaagctncaanaagatcctgngttnngnnctggagcaaccnntttacccccgcatttcctttctanttnttagaacntccatcggttggnttnggcaattnccncggaanncngcntnttgcggncanctnancccntntttaaaangttgtnnttctncccccanttttncttgnaaatccctacanggctaattccttcaangcttcnct

SEQ ID NO: 3688 - DNA, 767 bp, Homo sapiens
  misc_feature (1)...(767): n = A,T,C or G
tnctaatgctgggcttgntggcttgccgcagganccctcgattcgaattcggcacgagatagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttgatggacaaactgaagttgagagaattcgtaaccagcagacctgtagtacaaaaaatgttgaggcaagttttttaggcagaagaaaaatgatactagatagaaatttgggctgcacaaaggagtgaagaggcttccaaatggtaaattatatggaaacatatgaaagttatcttttctcatttttaatctctttgagaaactgcttaaagcaaaaatataaacaaggtactttggagtttagaacatacatagaagcaaaatgtatgacaaaaaatactaaagttagccaggagtagtggtgtgtgcctgtagtcccagctgtttgtgaggctgagatgggaggatcatttgagcgagcctgagaggtcgaagctgcagtgagctgtgatggtgtcactcactccagcctgggcgacagagtgagaccttgtcttgaaaaaaaaaaaaaaaaaaactcggcctctanactatagtgagtcgtattacgtagatccagacatgataagatcattgatgagtttggacaaacccactggaatgcagtgaaaaaatgc

SEQ ID NO: 3689 - DNA, 986 bp, Homo sapiens
  misc_feature (1)...(986): n = A,T,C or G
acttattntgggnctaantggngngccaaaaaaaaggntggggagcatggcttagntggnatcntgagantaatnatgagatctacnctgaaatgacttaacctanaattaatgtgtggncagnntgnaatatgtgaaattnnggcnttancnctcttttggcnntataaaaatctnnnattaaaaaacatgncattngaattgaacatgtgcntaaccnctgaantatntctganaaaccctaggtnccgtggcatatgngatgaatnccanngacnnatnnaaccncatnttacatannntcacngcntatnnaacatcaannatgcttgngnaaagggntannantncncaacgactnttgtttnngagcanctntcttngntagaccttntnaccnncnanggntnctcttaacnngntgatnnttnactcatcnttcnctttctttcctattctnnnnntccaaagtttccncncnnaagnnannatgaatnantngtgnncnnccaccctnatnattntanatanncgcnattgaaatntaatacanntcccnctnncctcnannnaatnccatnncatctnantaaaantatancantnncnttnctnaccncnnaaagattcaaanttcgctncccttnttnncnatatactctnnatannnatannccgaaattntcancnttctantnntnacntancaaaactcnctatagnaccctcacatncctcngacacnatnatnnccaanaacctntaatcggannnnacntntctgaatnnctcncactcctnttataccntntnntcattntaactctatcatctngnantangnccatctccctcanatctaaacannttntngcnctcnnntagnggagantgtctctntacgnctnanaanggcttctcngatcntcnnaatactcntatagagactatacnctcatnattgctcacantatctacaacacnng

SEQ ID NO: 3690 - DNA, 847 bp, Homo sapiens
  misc_feature (1)...(847): n = A,T,C or G
cnnattanngtagctggatgctggcctaaananaaggctgnggcnaattcggcacgaggnagcttgtgggnnagacnancaanggtgcatgangaanaaaacnnaattcantaagccngnnaggnacagcccatagtctnctcgattngtacaatcaaggcggacatttnctggntatgtggannagaggttaattggcngnctatgantggnnnagcctaaanttgngnntacntgnatnnnntnatntgcnnanaaangcatnnganttanagntnccaaaagntntgaaccnaaggactanagnaacanacnnntnatngcctggtnntcagtnatancnacaccncacaggggacnngatnttncccngnanttntnacaggtctcnnnanctgggactcaagncnncccatcatgcaatnncttcanannaacttgtgacttgcantnnnatactanancttnantcccttnttacattcctcaaatgcncaactccncttttcttaattccnattatnnactnnntnnncnngcttattggnccactnntancatncnggnannnccaactaancnnattnntngannttgatattggngccttaacnaacanancgtnnntatcgctnngtcaccantctcactcattnatcaannacnnnngcnnnantnattctcnatcnanncnnantttgctanantnnnctttcccnncnttnanttnctannaaaccccctntcnnnggcnccaatngnnaantngnacccnnncnntctnnangggntnactnggccncatacctcctgngcaanctntnaannggcanactnctnntcncct

SEQ ID NO: 3691 - DNA, 775 bp, Homo sapiens
  misc_feature (1)...(775): n = A,T,C or G
ctaatngctgggctctngnnctttnngcaanatcccancgattcgctgcaaaatggactgtgattcaggacctcctccttacctacgagcaccctgggagggactgactaatggcccagggacacacagtcatcctctgcaggcaacagtcaggcttctacttgctgaagccgtcaagggcttgactgtcacactcagtgttctggaaaacaaatcagtaaagcaatttagaggatcttttgcaaatcagagaaaaagaatcaatacaaggcgaaagaattctgatcagcactttaaaacgtgcttatcagaaacttttcttctctcttttaagctttggttctaactgagaaatgcactggataataggtaaccctccccagaagaacatggacttcatcatttcaccagattcacttgttccctttaaggcccagccaataaaagtatatggtatcttcaagctctgatttcctaatatcagagataaaaagccatgggaacgcagagacttggtgaatttgtaaaaatccaaaaagaaaggccagtcatgacggctcacgcctgtaatcccggcactttgggagggcaaggcagaaggatcacttgagcccaggaattttgagaccagcttgagcaacatggtgaaaccccatcttttaccaaaaagataaattatctggacatggtggtgcnagcctgtantnccagcaacttgggaaggtgangtaggaggatcacttgagcctgggangtggaaggtcccggtgagccc

SEQ ID NO: 3692 - DNA, 785 bp, Homo sapiens
  misc_feature (1)...(785): n = A,T,C or G
agnnnttctaatcnnntttcaaatcgctnggctactngttctttttgcaggatcccatcgattcgaattcggcacgagggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtctctaccacacctactcaactctgtcacgctagcacaaaacagccacacacaaaaaccaaattgggcagctgaaaaaaaaaaaataataattacttaatgaanaaanaaannanacnanttgannnttcttnntttttnatncnatnatcccctcntgtnatnnatccnttnatgtagcttgtgacaagnncnntncttnaaancatcnnnataaaaannncnnctnntttnttnaaaaaccttnnatcctcttncanttntttggnnganatntttnancngtntaaaannanttttttcaaaaannnattttnaanaantataagtcccngtttttttngntttcgggnnnngggtttttaannngggncntnngtcccaannctttgggnnccnaaccnntttnn

SEQ ID NO: 3693 - DNA, 753 bp, Homo sapiens
  misc_feature (1)...(753): n = A,T,C or G
aaatncnagctactcgttcttttggaaggccnncatcgattcgaattcggcacgagattttcatccgaggcattgtctaatgatgtcccactgcgaaggataaagatgtagttttctttgactctgccacctcccactactcagctcactcatacttcctgccatctttcatcttcccaataagtatatcattatggntacattagtatcagggtttacattattatgaccatgtaaatgctatttctaactgagccatgtagtatactctgatnactttnnctttcttgcncaactttgnctntnctatggatngctacttatccatattgcttatntgctaagctttctgtatacttatcattgnctatgnntntgatctccaaattntcctncaggtgcctgaatttcctctnggnatgtccagacctatctaaatnttatantaatttaaccttcttggtgacatccatnctgnagnctttgttcacgacaatgctgtcatgctgagattaactgtcatcattatgggtatcnactttgcctacatctgngtctnnttnggatctctnnnttgtcagaccccttnctttcactcncttggnctgcactnaaattnggtggagcacatgcaatantangntcctgaggtatggtgaatgggaggcacatnattgaggtctngcanactgaaaatggtttacaggagnggcaaaccatgacccatagatgaaatgtacctggnacctggtt

SEQ ID NO: 3694 - DNA, 799 bp, Homo sapiens
  misc_feature (1)...(799): n = A,T,C or G
caaatcnctaggctactcgttctttttgcaggatcccatcgattcgaattcggcacgaggcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagcccggagcagaaattgctgcccgtgatatttggcttcttggcgactgcggcatatgcagtgaacacattcctggcagtgcagaaatggagagtcaanccgtccgccancanaagcaccaatgactacattcgagcccgcacggagtccanggatgtggacaagtccgcctgagatncancgcctggacacgctttttctggtaangaccgctgggattgaacagaacttccggtaaataanggccccgtcggcaagacagcatactgctgtcacaaagtgcnaacacctggaaaagaaagacaagtgtcactggcctaaccatggtccccacttctgtcattcacacaagttttaagtgggtcttgccaccanaaatcctcttttgctanggtactccggaattgcttccctgnggctttnatcttaaatacttaaccatgggannaagactttcaagaagantcaatctttaattccttccctcaattggctaaaatttttcttaaaaaaa

SEQ ID NO: 3695 - DNA, 876 bp, Homo sapiens
  misc_feature (1)...(876): n = A,T,C or G
gnnnnnnnnntttnnaacttnctaatncnggctactngttctttttgcaggatccctcgattcgaattcggcacgaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatgggaaaaannnaaaaanannnnnnnnnnnnnnnnnnnaaaaaaaaagcctnttagaacttttaggggagtccgtatttccgtagaatccngnacntggataaggatcccttggatgnagttttggacaaaaccccaacttggaaatgccnttgaaaaaaaatgcttttnttttnt

SEQ ID NO: 3696 - DNA, 876 bp, Homo sapiens; identical to SEQ ID NO: 3695
  misc_feature (1)...(876): n = A,T,C or G

SEQ ID NO: 3697 - DNA, 1151 bp, Homo sapiens
  misc_feature (1)...(1151): n = A,T,C or G
ttctaaatactaggctatngttctttntgcaggatccntcnattcgcgccgcaagctgctgaatgccttgggactagctggtgattacctcgcccagggcctgaactcaccctggccaggtccanacctttctgctgtggggagcaagggccctggtcgtctactggctgctggctctgctnctcggcttggtcttggccttgctgggcngatcctgtggggctgaancttgtcattttacttggccgntttcttggccctgatgaagtnngtgccccgaaacctttttancccgggccctggttaattctggncctttggttgaatcctcttaanancactgcttatancccngntttaaannggntttnccaaaacctctttngggggtnnaaaaattttataggccaaaatgnntnncaaanggcttttnnaaacncccnctttggtaanggaaacntttagncnttnngnccccntaaangnccaaantcggnnccanaaagggggggccccnccaaaaanttggnaatgnaaagnaaanttaaaaccccgatntngcncccaaaaaaaaaccggnccaatnngtttcattaacccnnaaaaaaaaacntttaaaacctgngnttttntnngnggccccaattttctaaaaacccttntcctttgcccaaaaacnccccccttggggncccttnttttnnaattttggncccccttggggncttntttttngaaaaaaccttttttaaagnaaaaacaaattttgggaatnncctnttttgccccngnnanaaantcccccccaanantttttaggncccccaaggnaagggnaaaaaacccnctccgggaaaaaagggnaacccccaanttttnccccccccctntgggcctttgggttancccntttttgccggggggnnccccttggggnnnntttttttnntaaangggggtttccttctttgggnccctcnggggggggtttttnggggctntttnttntttttaaaaacccccctttttnatnntntgggngttttcnncaaaaacctttggggccctttaaacccaagggggaaaaaggttttttgaaaaaggggggcccttatcnctttttngggctttntttgggnaaaanatgggcg

SEQ ID NO: 3698 - DNA, 764 bp, Homo sapiens
  misc_feature (1)...(764): n = A,T,C or G
atacagctcttgttctttttgcggatccctcgattcgtggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagcccgcccctgccaagggcaagaagaacaaggtatccacgagcccgtcagacctgggtggctaccaacaccctgagcaaggcggccttcctgttgacagtgctaantgagcgttcagagcaccacaacctggccttccgagttggcatgtttgccttggagctncanangccttcancttntacaaggncttggaagtgaaacttgcattccangaatctgaagtggctgncctgctcaaagaagatccctctgggtccaaatgagatgagtaccatgccgtgccgggcanangaacttcgggaggggacacttctgtgactatcggctgtgttgnctctcatgctggccagttcatctttgacgtctctgtgctccaagtatgatgcctgaccctacagtaagtggggaactggggtangggtagctttctnttaanaaagancnaagaccccaagtttctgaatcacctttaggaccatcagcaacttcatgggttnccggccccaagtcgcaactggaacancgagacaccttggggataagaancttggatttnaacacannttgcttgccttgggcatgaaaa

SEQ ID NO: 3699 - DNA, 867 bp, Homo sapiens
  misc_feature (1)...(867): n = A,T,C or G
ttcctaatgctnggctactcgntctttntgcaggatccntcgattcgaattcggcacgagaatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcatttaccttcctttgatatttangggctctattgcctgctaatttcatcactgntatttttcttacctcttatctttttccctgtagttattatcagcctaatattcattcattcattcatttaccttgagtttttaagcttgtgcnnaaaccaacaaggttggggcccnagtttncnagaatgnngttncccnacnttggnaagtaaacntgggttangggaaaaaangtnnccancttggccctttttaaagacaccaangttttacccncattccatggggttcaatggggaaggaaaaacnaaaggggantttattttgnaaaaaactgttgccaagattcccgaaaggggagccccctngaaagcttttaaacctnccaannaanccttncnagacccttttggccttttaaatnccctttttaaaaaggccccccantnagggaaaaaattcccagantgaatggggttaccnggtcttgacctttanggaacatgtangcttgncttgcccnatgttcccncaacattnggtccccttttacaatgnccttantacattaatnggngggcccctcattttnaaattttaaaaaatttcattttanccttttaaaaaattcnttttngcccaagaaaatgttttct

SEQ ID NO: 3700 - DNA, 935 bp, Homo sapiens
  misc_feature (1)...(935): n = A,T,C or G
tncntatnctttgaantcctttttgcggatccctcgattcgctttttttagtgatcacttttgaattgtgttcagatatgcagtttcaggtgtnatcatcagagctggttagtcaggcattccagatagtggttcttttcagaacctttttaaaagggttgggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcanaggcttgtaagacttcctcatgaccntnattacaggccttgcttttggccgnattttggggctgaaaaagcacccttgcttcttcaganattgnagntatttggatgtataatagtttanccagatggtacttttggtaagacatcagatgttcaaaaaagtgcattccaacttgtctaaatactgcagtgtcccctttataaaaaggtcagacctaaaactggccaatttgntacanccggaanccctggncattttgggatatttttggaaaggtttttttccattaaaattcatttgggaaaatttaggtaattattngggcttggtaaaggttttaaacccttttttttaaggggtnaaaaaangggtattnggttttccaattttaagtnggccattttccttttcccttggcttgggnattccacctgggtnaaaaaccattggttgggaaaatccnaagcctttttncccaaattttccctttaatggcccangggttccaattggaatnaaacctttgggtaaaaaaggtttnnaagtttcccaaattccatttttggnggccttaatggggtttttttaaaaatttttccttnaaaagccnncccctttggt

SEQ ID NO: 3701 - DNA, 977 bp, Homo sapiens
  misc_feature (1)...(977): n = A,T,C or G
atnccanctacttgntctttntgcaggatcccatcgattcgaattcggcacgaggttttaagtattctcatccgtcaactgggattggtaatagtacagggctgttaggatgattgcatgagatgaaatacatttagcacttggtaagcactctataaatatggcaatatgatagtccctgactcatcttcctctctgntgccctttaaacaggtgagcacctagccttgttggttttatgtgctcaacagcagttggacttcccctgggctcctctacccatgctactgcgtagtcaanccctccataaanctnctctctggnctctggttcccanatggnctttggcctttcctttttccttcccancttaacgtttttaaccatgccccngggaatnttttttgaaaangggaaactgganccttnggtnccccnggctttaaaaaaccnnccaataaatttnttacccncattagnagggnntaaaaaaancctaacttttttggggnggnantacctgggactttttctttccgaactttttcctggcccttcaaacttttccaaccctctttccccggtncattggggatccctattacccgggaggaacattacccaaaaattncctttaaaattttcttnccaaaacattggaanccttttttcccgggctttctttttcaataatggtancaatggttcccaaaaggccaaatttnattcttggncctttggaaacctttttggggaaaccaagaacttcaactttccatngggccccagtttttttnccaattcaagggaaggttttttgggcttggtaaaagggntaccccaacaanttggccaagggaaaaaaaaaagaagcccaccttgggggccttnaaacctggggtngggggaanaaacccctggggggtnccccttngggttttncctgggggnccttncccaaccttaagnccccacna

SEQ ID NO: 3702 - DNA, 932 bp, Homo sapiens
  misc_feature (1)...(932): n = A,T,C or G
naatcccagctacttgttctttttgcaggatccctcgttcggaccctcatgccccgcttctgctccagcctttcttactcattaggctctagtctcacttcttattttttaaattgtgagtaattttcatgcttggtagttgatttcttttccatctctgnatgcatacttcctgcacctagtaggcacttgatttttttttctttgaatacacagcagatgccatgtnaactcattagtacttgcctcaaaacactgaattcttacctgngttaaatgcntgaatcntttaaactttttaagtttacctagaaagtgtataaagngggaactaatcnnttntgantggnnataccncccnngntttgaaaactacctttgancntttttttcctttttaatnaagctcttaaaaccggttaancagccccccgnggatannaaagaancttttaagctggggggaacnccttcattttcccnggaaaaaaaacngnnccaagggcttggggaaaaaaatgccnctaagggattgttttccagccnttccagaaatttttgggccnaacctggangaagcttcaaaattccaaggaaattntggtaaanggggntttttatgaggccaaattaaatngggncctttagnaanccccntttaggaccaattttaaatnggtttgnaaaaggcccagccttnggtnaacctgggncccctttggctttngcttttttngggnccattcnttnatacctgggcnaaaatttaaggnaaatttacctccaggtttnaaaaaaatnggncncctttnttggnaaaaaagtttcccttgggngggttttaaagggaaaaanaanaaaangnnaaaaaaaaacttcgagncctttttnaaaccttttngtggaggtccggatttaccgttagantcccc

SEQ ID NO: 3703 - DNA, 789 bp, Homo sapiens
  misc_feature (1)...(789): n = A,T,C or G
cnaatngctaggctactngttctttttgcaggatcccatcgattcgaattcggcacgagcactcttttatattagggacttgagcatctggagagtgtggtatctgagggagttcctggaactaatgtgcagatgccaagggacaactgtactattgtacttggaagtactcatggggtcatattgcattgtttctttgagtcctaattctgccaacatggcctggtgcttgcattaatcagctttctaatctctgagtaacaaggcacagtaacaaggagcagtaacaaggcacagggctggcacctgagagtggaggtacccaggaggcagacaccataaggcgggaaatggacatatgtacagaatcatggctgcatgtcctgaancctggcttaagccatcaacggctgctgggcaagggccaaagccctgttatccctttcgcccttnctgatggctctgtctctgccttcactgggtgtgggcaagccnnacccacccnaggctnnagccctttacccacagtgttannaaatgcaancttcaataggattgtncttnaggcccttncccanaaanccnggattttgacagggggcnatganttcannnnccngcttttaatggattggcctatcggttttaaaaataatgaccaatnggggcnttgngcctggccnanaancnntnancattcnattttcctgccaatttttgggtcnaaatnccngcngnttttncnctngnnnngttnnaatgaactgnaanaaaatnnntttgnttgng

SEQ ID NO: 3704 - DNA, 805 bp, Homo sapiens
  misc_feature (1)...(805): n = A,T,C or G
ttcnaatgcttggctactcgntctttctgcaggnatcccatcgattcgttcaaatctgccactcccagagcccgtggaactctggcccaaggctctctgactgactccttcttggcttagcggctgaagactgacactgcccgatcgcntnagaaacaccgtaaaccatcacggangccgagctntacttanctttcanagtggaggaangcnggaatgtnangcctctnaacccaagccaagccatcacattccctgngacttgnacgtatgcacgtntgcncctaaatggcctgaanttactgaataatnacanangangtgaaaaggccctgtcccgccttaactgatgacntttccaccattgggatttgttcctgccccaccttaacngagnganttaccctgtgaatttncttctcctgggtcanaanctcccccactgatcagcttggganccccgttcntnncaccatanaacaaaccccctttgactgaaattttcccattaccttcccanatcctataaaangggccccanccttatntcccttcgctgactcttttcngncttnnggcccatctgnccctggcgaaataaacanccatgtagttcacataanaanatcntttaaaaaaccttngancccttttnnaantatantggaggcccnttttangggaaattcccgnantttggataangataccatntgtannanttntgggccaanacccncaaactntgaaatgnccatttgaanaaaaaaaangccttntantttttggncnnaaaattgngngg

SEQ ID NO: 3705 - DNA, 868 bp, Homo sapiens
  misc_feature (1)...(868): n = A,T,C or G
naaatccctggctactcgntctttttgcaggatcccttcgnttcgaattcggcacgagccagcctggccaacatggcaaaacactgtgtacactacaaatagaaaaattggccgggcatcatggtgtgtgcccgtagtcccacctactcaggaggctgatgcaggagaatcgcttgagcctggagggcggaggttgcagtgagacgataccgtccactgcacttcancctgggcaacagcaagactncgtcttcaaaaaaaaaaattttaaaaagatttttcttatggngggtttcaaaaaatggttgtnttggcaacgctnggtgccaatgggttacccctgnntaatcccnccactttttaaaagncccaaaccgggtggggatcaccctctanggtcnggaaattttgtnnnacctttggggtnnanaattnngngnnnccccccatttttttcnttataaaangnaccccncnaaaaaattctatttccncggaatttgggtgggcaccgttgcccttggtaaattcccaanctttctttgggggaangctttaaggcccaggnaaaaaattggncntnaaancttctgggggcttcaaagccgaancanttnccaaccttcaaccttccatatnnanttggggactacnagggngccncccnancnttttnctggctaanatttactgantttcangtagagnanccanctttnnttatttttncccaaanncntgctnnnaaattcntnnctnttatgnanccnaccaatatctnnntncccnaaaattctngnnaccnttnntctnagaaacctnatngccncnantannncctngggttcannntttccccntccntttc

SEQ ID NO: 3706 - DNA, 855 bp, Homo sapiens
  misc_feature (1)...(855): n = A,T,C or G
cctagttcnaatngctnggctactngttctttttgcaggatccctcgattcgaattcggcacgaggtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcctattttgtacactttgnggttgaattcctnggaaaacctggcttctgnnaaaaaccttttncttaggaatntgtttngccatctcttaacnttacaccntgccctgtncttntccactggattgaaaggcccnataaaggaaggggagggaagggaaattgatttcaaaggccccaaatgggccacattttaggaaagaataccctcacnatggaataancccatttggttaatgtngtggtgccaaatttttatttaaacaagtgcctggngtaatggtgggtggggaccaaagtttattntggaaaatatcctnagtnctttcttagaatanttttgggaaaatgccttggatggtattttaaaaagtggtaagtagaaatanaccccttttggaaaataagcctttttaaaaaacctgattgggnaaattcctngttttggaaanttggaaattggttggaaccancctgggaaggtgggaaggggaagaaaatgccaatgggggttttggccattggttnta

SEQ ID NO: 3707 - DNA, 778 bp, Homo sapiens
  misc_feature (1)...(778): n = A,T,C or G
gnnnnttnnaaannnccnggnttcnngnngcccttgtttgnccnananaaacncnntgnaancnccggctcgcttctcctcttccattgcgatttgccttctttatccagncttnnggaatgctgatttnaaatgtnnntggcacaaggcaggcgtgaaaacataaagttaataaaaatcgaatgcataagctagagcagattatccacagattcttccatctccatatagattatcaccattgcctgcacctgttttccttctccagcctatctgatggaatggtgcttccatgacatgtggtatttggaaggctcttagctctgatgtaatcagggtttgacccatagtcacctgaaatagnncttctggnnctctttggtctatgaactgaagggtctcagaagcccgtgttatgcaaatacccttccatccccttccctctccccttgcctctatccatgttccctcagcctcagggtgcttgcaggctaagaggattgggnctctggcatcctggagctgaacagctcgngtcaggaattccccaggcccttgagnctctggggtgagttgnaggggtgtgtagggngctggggattaaganctgctgagtaggggcttaccagaggtatactgaaggacctgaagacagatcatcttcacataatcagcatgaccataatctgggatggcactgagcttctttnantcnggagncaaggaatgngcncaagnaangcaaantaatnccttttaagcccgaggatnagggaan

SEQ ID NO: 3708 - DNA, 788 bp, Homo sapiens
  misc_feature (1)...(788): n = A,T,C or G
ttnnaannnccnnntttcaaatngcnaggctactngttctttttgcaggatcccatcgattcgagtgattaagtctcactaggaataggcttttctaaattgntttatctcatcctcattagaacttcaccacatgtgggaaatcatgtggcaaaactgtctctcttaaaaaaaaagtcaccaaggaaacctccttctgcaatttaagaaataaaatcccagtgacattgatttggatgctccaaacatgtccataatggaagagcttttccaggttttggtttgggccccccagaccaaagctttgacacataatacaagctctgtaagtctgttttcctgtctgtaatttgggattgtcatctttgtagggtgtcatggagattaagttattcactgtagacaatgcccctttcatgtaatagattctgtcagtattagatctttttctttctcttcaagtttcaaacatagattaggcaaaattttaatggctatttcacaaaatcagcttgattcttgtttatgacatcaagtgttgtttttccaggttgtctgttaaagggctacttttttttttctaaaagtgcttttanaaattccagtgttagtatgtatgcatcatttaagctaagaatgaagatntaaagatcacccaacagtttaaagctggattcttttancaggtcaaaggagaattgngntttgnctagctgncttanccgtgtcggacttcttggactcaagtgatcccacctgnccttaanctcccaaagtgccnggaggtt

SEQ ID NO: 3709 - DNA, 750 bp, Homo sapiens
  misc_feature (1)...(750): n = A,T,C or G
gnncngccttnagttccncangcgnactctttgnacgancttatgaacagatatggaggccagagctcatttgggtaaacttactcctgctgagttagcattttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaaagtattgnagcatttggttggatccatgaaaaaatgtattcagtgggcttttaaaatttccatttgcagaatttggnctctcangctgtttggggagctcttttttttaccattttttctcctttgcacctatttnatggnggttaaagtaaanggtnact

SEQ ID NO: 3710 - DNA, 895 bp, Homo sapiens
  misc_feature (1)...(895): n = A,T,C or G
aanagcnnntcnaatngctaggttntcgctctttttgcggatccctcgattcgaattcggcacgagattattataagactaacattctgataagccatggtataattaacattattaaaatgtttacatataatccttcttaaagtatactcttttaaaaatccattggcataaccttacttttagtttagtgatccagaatttccccagagcttaagccactgcagtaaattaggtaccgtaggatattcagtcgctactagccacaaggagtctccttattttaatgtacctccctcagtactttattcctgcagagcgcctcagagtgggggagagaaatgagcaatcctggctcanntggattatttcagcattttattttctaaaatctgtagtgtgatcccgaaaatatttaaaattaaaaaaaatacttttaccagaagagaggcctacctaatcaatgngctttagagaaacnaaactaccctttaccattcaatttaacaaccnanaaaaaggtttacccgaaattttaacaaaacattttttctttatctgaattntggggaggaaaatacttaatgctgacaccgtttaataaatttaggaaaaaggatccattcccaggaatctttatgggaaaaaattgggggttttnaaatttccaagccaggtttggctctttggaagaacatngggtaantcctcnttaaatggtaaacttncttaaaagggannaggggtaggaattnggaaaaagggaatctttgggnattnttacccnttaaattaatgggtcccaggaatnggggtttcaagggattnttncanaaattaaaaattngggtttttgggttgggaaaaaaatggaaatacccttttttnggggggg

SEQ ID NO: 3711 - DNA, 765 bp, Homo sapiens
  misc_feature (1)...(765): n = A,T,C or G
naatngctaggttnanacgctnggctctngttctttttgcagggatcccatcgattcggtcgtgactcctgtacaagggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagatatatcatactttgttctggcctcttgaatggacagtagctggcagagagaacaacacttgttacgcaaagataatctgcaataaattcgaccatgatcgggtgataggatttcatattcttnggaccaaacgccggtgangttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctagcctgctgctggttaagttctncttgncatattctcatttctctcaaagataagaatgctctcggatnaaatgagcctgtgctcatgacanctgctctggtacttanggaccantgcaaggcttncttaccacacttagatgagaaagttnncaanggaaaaaggncaccaatngggcattttgcctt

SEQ ID NO: 3712 - DNA, 807 bp, Homo sapiens
  misc_feature (1)...(807): n = A,T,C or G
agnnctttcttacgcctnntgaacttnttgnaantccntttttgcaggacccatcgattcgaattcggcacgaggaaaggacccatgatgtaaggatgtcttttttggggggtgcttgtggctccttaactggctctggaaagagcctacttcccatagtgaaccctgtgaggtccaattctgttcctccccttggagctccaagagaaggtcattgccttgtagcagcaggtgcccccccaagctgggttctcactgcaggtgccagcgggctctcagtaggtatgacctggatgtgagtggtgaaccaggattgaggcactcagcaccttcgaccacacttccactctccctggggttcaagtcaggctatggaaaagtgtcaccctgtttgncatataactggatgggtngtaaacagaacgcctctggcaaaggtngaccttgaaggcaaaactgagttgagggttgttaggacggaaataattactgctgggcatgcaacacttcccaaccgttcttgtgangcaagcantgttattgncagtttggcacaanggcacangtgtannaacaacgtaagtgccctggggcccgtgcttacaccacccactgnggtttgaacttanaatgtgaacccaaggccctttttgaattcccaaantccctcaatcccttcaatcctaaacaagcnttgcctgccgggttanccaaaaaagggggacctccnggnaatntngctcttggcanntttntttaaanctggatntattaatggggaaaaccananntanaantntttggtnt

SEQ ID NO: 3713 - DNA, 909 bp, Homo sapiens
  misc_feature (1)...(909): n = A,T,C or G
ttgcnaatcgctaggctctcgttctttttgcaggatccctcgattcgttttttactatgtaccataatgtcccattcatgagaacctagcaagtagtttttctcattagcgaatgctagaattttattttttttcacatagtgaaaaggtgaaattggtctgtcttcctctttactttagctgctagtaaggttgaaacaacgatggtgcccaaatttaacagttaggtgacatcttcttctacgtgtgctaagattacccagacttcactttacccttatttcccactgactttgatcccttttacttgnttttattctgnaagtatgtatttttgncatctttcagnactctttggnatcnnaataaaattaaattcccctagnctttaaanangataatngggtnncttggnttaaanattaaaaatnaaaagtnatttngggctttnatataataattaagccantaagnnatttttnggcnaaantccttttcttgccanaagggggcccagaacgggnttaaatattttttaagggtggtttnccaagggccaaggtggaatcctcttgggttggcaaacttaaccttcaagccttcttggccggttccgttaaantgganggaaaaaggccaggccccttnnggacccaatgggccatttaaaggcccaaaatggggggttngttggaacttggggggttttcccaanttaaaaaacctttttaattttttncnaaaaaanccaatggggcttaccattttggactttttnngtggttngtaattttggccttacccccccaaaaanaaanaaanannnnncttcctatattnactnnnanactttcantnancaaaaaaaaacntgggcccttttanaactttngngggncctntncctan

SEQ ID NO: 3714 - DNA, 752 bp, Homo sapiens
  misc_feature (1)...(752): n = A,T,C or G
aaatnnnagctacttgttctttttgcaggatccctcgattcgaattcggcacgaggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttncagccccangtacccagtttgttaaacccgacagttggagttncacaagtgttcttccagatgacccctgtgangccaggcttcacaatgcctgtganggccaccaccaaacaccttnaccaccgtcattcccggcactnttaccattcgnaagcaaccgtcccaaagtcccagtct

SEQ ID NO: 3715 - DNA, 960 bp, Homo sapiens
  misc_feature (1)...(960): n = A,T,C or G
tttcaaatcgctnggctactcgttctttttgcaggatccctcgattcgaattcggcacgaggtctcgagtttgttgttttttgtaatccgttttagagtgaattaaactcagacatccctggattgtatgctgtctgtagaatgttgattttcaggcacggggatgtagctgtagaatgtggcttggtcattcttcctgataagaaattgatctcctgaatggattggccatttggtaatttcttagtgaaaggctgactcttgaatatggctggtataatataaattcttaccaacataaaagtaagggcttatttggggcttgggtaaaactgtcatgccttggangatatatagcttataaaattggcttaaccntgnattttatgacctanctnncccctgntgccaacntttnacttgccaaaaancctgggattcntgtttnccaagggnngaccttattatttgtggaagaaaaatttggattnnccaaggttaacctatttttcaanggcttcttggctttttgnaatttttcttcaatttcaccatggccntcctttttattcctnttttttnccccttcccaaanggggttccnggggaatttancctggtttcccgggaaagnaaangaangggatttnttccaccanttaaggccanccccaaatttttttaccccacctttccaaaaaccccangggaagccttaccttacctgggngggtnaaaaattanggggtttaaccaccccccaanatttgggaaaaatcctttttggccaaaaaagggttccngggttcctaatttcaaaccggaaaccagngnacttntttagccnaaaaaaggaaaggaatccgtttccccattatttgggaaccgccccccattttaaaatttncccagnggttttcctttaaatgggaacctttgccaaaagggaaatatttggcc

SEQ ID NO: 3716 - DNA, 769 bp, Homo sapiens
  misc_feature (1)...(769): n = A,T,C or G
ttnaaancccnnttncnaatcnncagctacttgttctttttgcagggatcccatcgattcgcaaagcttgatctattaatatattgatcagagttccatgatccttttctaaaatggtggctttattttgccagaataattctgcagggtgttttttttgggacggagtctcactctgttgcccaggatagaatgcagagtggcacaatcttggctcactgcagctcttgcctcccagtttcaggagaattgtgtgaacctggaaggcggaggttgcagtgagccgagatcaatcaccactgcacttcacctgagcaacagggcaagacttcatcttaaaaaaattttttttggatttatatttactganaaggtctgttactaaagggtttaanatttggntgggtttnaccgctaaatgtttgtanagtctgaatctntggcctnggnaaagaataattacangcnttcaccaagttgtgaaaccttctgggttnggatgaaaagaaactttcaagctnagaggaanaatgttctgaaatatttggggaagtttggcagactcctttctcaaggggtatgttcatttgggccngtgattctggaaccccctttgcagatatcttaagtgtgtcatgaaagtttaccaagaacattgtgagtanttgcaattaccaaagggaaccaatgttcatattactttccattatccggtctcaagnattcttncngagatnctttaccctgtgtaaagtgaatcncttcntct

SEQ ID NO: 3717 - DNA, 756 bp, Homo sapiens
  misc_feature (1)...(756): n = A,T,C or G
naatcgctaggctactcgttctttttgcagggatccctcgattcgcagagctggggcatggcatgtctcaggaagccatgcttgtcacagaggaatcactccgaggctaaaggaacatctgggcaatcctacttgtgtactcattggattcattcagtgaccttgttattatccttctagctaaatgctctgggtcttaattcacgactccaaggttgctcttgattttaaggaacattttggcagaatagagagaagttgagcaaatattaacagatgtccaaaggggcagtgtgatttattatgtcaagagaatcagttttatgtcgagggaagaattttggtagaaatcactgtattttttggaaaatatcatatttgggttttttcattgnataagtaatacatggatacatgcttatataaagaaaaattcataatatagaaacataaggaggaaaaatgagtcatttttctcccatagttcactcctttcccctccctttcagtaaccagtgctacacgggtgtgtctttccagacgttaaaagcagtcatacatatctctaaagggaaagtttgcgtttgcttgntntttcttcctgnattaataggatttgggtatatatatacncaccccgtaatatattttggatctggatatntaggagcatatttctggggtgcgctttttaaaattttatggccaaatcctacagcttcttcatgtnacttgcttattngatgtttccncant

SEQ ID NO: 3718 - DNA, 766 bp, Homo sapiens
  misc_feature (1)...(766): n = A,T,C or G
ttcnaatngcttgctctcgttctttttgcaggatccctcgattcgaattcggcacgagcccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactanaaaggctgaanaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgttcactgcctcggccatgcccaacagactgatgatggagcatgttctcttagtcagcatccttnaccacacagtttggaatcgaggtcngtgcccactttcttggaggcattggtgaggaaagttcgatgccnntcttttnaataccggaagccaaagggaaanganttgtnacaacctgttcaccgtcattggccattttatacaacttcccgtggtnct

SEQ ID NO: 3719 - DNA, 755 bp, Homo sapiens
  misc_feature (1)...(755): n = A,T,C or G
ttncnaatcgctaggctctcgttctttttgcagggatcccatcgattcgaattcggcacgagggacaaaccatctccagagccttaatcgcatctgtaaagtcccttttaccatgtaaattaatattcatagtttctgaagatcaggatctggatttcttttggggcaattattcagctaaccacatattataatgaggaagcacttcttgggaggcatcataatgcttgttttttcttttcctaaatagagtatcacttttacccaaatggaataactcgctgggttattttactgagctcttgatgctcatttctttggtcttctctgtgatgaattaatgtttctatatggacatcatgcacaatttctttattcctgaagaatattttaaaatgntgttattttatgttgtagttggtgtaatacggtgcccagtatgcccgccaagaatgcagacagatagaccttgtggataattattttgtgaaagacacatctgaagctcctagcagttctgatgaaaaatcagaacaggtatgcttctcaatttttctttatattcctatcttgatatcaaactgtaagtataagaaaaacatgtttggatagttaagtcatttaaggtggttctgctatggattcctggttcaaatagaaagttaaagatagctttcttatatactctcaaacttagttnaatgagactaaagctattacttaaaatgtcaaaatttgggccagcattgggggct

SEQ ID NO: 3720 - DNA, 753 bp, Homo sapiens
  misc_feature (1)...(753): n = A,T,C or G
ttncnaatnctaggctactngttctttttgcaggatcccatcgattcggtcggtgttacacacattcacacttgcaggcgtgcaggtcggtggtgttacacacattcacactgttgcaggcgtgcaggtcccgtggtgttacacacatgctgttgcaggcgtgcaggtcggtggtgttacattcacactgttgcaggtgtgcaggttggtgttacacacattcacactgttgcaggcttgcaggtcggtggtgttacacacattcacacttgcaggcgtgcaggtcagtggtgttacacacattcatgctgttgcaggcatgcaggtcggtagtgttacacattcatgctgttgcaggcgtgcaggtcggtggtgttgcacattcatgctgttgcaggcatgcaggtcggtggtgttacattcacgctgttgcaggagtacaggtcagtggtgttacacacattcatgctgntgtgcagctatcacttccatcttcagagccctttcatcttaaaactgaagctctccatcacacaagtgacccttcatgtnccttcccagtccctgaaaaacactgttcaaggtttttcttcctgggacctcattgtgtggagtttctcgtgtganttgcagtnacacacgattggccttttttttttcgttgttgagacaaatcttattctgccttcaatctggggtgtcanaatgagaccccatntnaaaaaaaaaaaaaaaaaaaaaacttgagccttt

SEQ ID NO: 3721 - DNA, 775 bp, Homo sapiens
  misc_feature (1)...(775): n = A,T,C or G
ttccaaatcgcnaggctactcgttctttttgcagggatcccatcgattcgaattcggcacgaggcaggtcccctcccacatctaatccaccactaaggcctgcttcttaatagctcttgttcggctttggttgagacagggttttgctctgccgcctaggctggagtgcagtggcgtgatcactgcagcctccaactcctgggatcaagcagtcctcctgccttggccttccaaagtgctgggattacaggcgtgagccactgtgcctagcctgaatagctcttaaatctatccacttttcttcctctgcacacctgacaccctagtcctgctgccctcttctccacctggacaacctcgcccacccccaagttggtttcccctcatctactcttgcttcctttcagtctatcttctgtcctgaggtcagaataatttgttaaaaatataaatggggtcaagaatgagttggggatggagctganctagagatgggttgggttggggttgggacttggataangcatggaattggggttcaactgatgtaaaagntaagaataggattgggatgatgatgaaggttgaactggggatggcttgggggttgggggatgggcaanggcttgcctactnaccanaatttgccctggttgcacaaagttttaacccacacccaacctncgntaanggctgggggaacnttnaagccantccgaatagcttaangggccctgttgggcntttcttgaanggggtaccagttttttttcct

SEQ ID NO: 3722 - DNA, 761 bp, Homo sapiens
  misc_feature (1)...(761): n = A,T,C or G
cngnnnctngttctttttgcaggatccctcgattcgtttttttttagaacgtggtcttgtctctatcctctggacactgcagcgtacgagtaacaacaggtcttgcaggctaaataacttataaacaaaatttccttcctgaggagctaggtattccgatgtatcttcaacatagtcctgaagttcatatggcaatcgtccttttggcttctgaaatgcagaaggccatccagatttcggccaactagaggagtctgaaggaccagacaattgctcagaaacagaaggctgtttagaattttctaaattcattaagggcaattctggtacttttctggaaattggctttaagagctcatcctgcatttttaaaatctctccaactggatcaaattttttatatactcgtttgataggtttttttaaaacacatgactcttcaggactacaagcagtattagtctggtttcctacagaagcctgtcctgaggaagaatttggactagctggtctggaacttaagttagaacccacaacagctgtctttccatcactattatttttacattctgnatcaatgattaaacactcctcatctgtatcactgctgcagagaactgtatcttcagtttttgctgcttctgatccaacagtcttttcctttgagttggctanggtttctagaacattaggnctttcaccatcagcatgtaatatatctatagncatatcattttattagaagttcaatttcttgaaat

SEQ ID NO: 3723 - DNA, 780 bp, Homo sapiens
  misc_feature (1)...(780): n = A,T,C or G
ttgcaaannccctgtttcnaatnncnaggctactcgttctttttgcagggatcccatcgattcgtctaaattcatggnttatatttatatatgtccttaatcctcactcacattggccctacaggtagattcattgctcactgtcagttctcttgctgaagttttcctatttttctcttgatttgctgaaattccttctccagtagtttaatcaaaagggactaaatgaaaaaaaaaatattcagttgttgcaagttcaaaaaggtttttagtctttgtgtttgattgacagctttccagcatataaaattcttaggccacactttctttccttgagaacttcacagatgtcacttctggctctagagttaaatgcccctgtgggaaaaacttgagctaacttctattttggtaccctttatgaattgatgntttcacttgactgnccaaagtcttttttatttaactggttccccctttcttttatattttaagtctagttacttttcatagaaattacccttggtattgacagatttttgncatttttccccaaagacatggtgtgccctttcagttcgtagatttatcttcttttacttcaagaaaattttcttggaatgatatctttaaatatttatgttcccctatttgagttttctattctggggatatatgatgggtcccttgnagancttncaaatctgnaatttctctgnaatctctttacaccggtcatttcaatttcctttgctcactttcctcatcttggtctcaggg

SEQ ID NO: 3724 - DNA, 768 bp, Homo sapiens
  misc_feature (1)...(768): n = A,T,C or G
gtgnntnnnnnntttnnncnaaggaactctttgcnanttnccctttttgcaggatcccatcgattcgaattcggcacgagcctagttaaatcacaacaagttagtaatnnataaatgatgtgtcctgtttctctttagtagaaattatatttttggctaccagttaagaaacttgtctcctttgtcccttatgttactataaactcaagatgatgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaacagttccaagtatactgcattatcttgagatttgaagatatggtgcccacggggattatactaggcaaatgcgttaagcagctctggcctaggtgttgtgtattttaagagactctatcttaggagagcttaagtgattgggctgcaggaagaagacattgtaacccaggaattaaaaatggattcagattgcctgattttaacactttagtttcaccataggctaattatgtgacattgggcaagagacataattcttctgtccttagttctacatttggaaaatagagatgatttgggaacttattaataagatttttgtgagagataaataaacaaatncttttgnaaaaaaaaaaaaaaaaactcgagccttagaactntgnggg

SEQ ID NO: 3725 - DNA, 793 bp, Homo sapiens
  misc_feature (1)...(793): n = A,T,C or G
gtncnatnngtgntantnngcgncttggcctaaananataggntngggcgtgattctggaacagagtgcacaccaggagaatctaagaatttgggtcaaaaagaaaatggcaattacatcatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagtgaagagtgtggaagctatccaagaggccttctgaattcctctgacatatatttgagaaagggcttggactgtgaaaagaaatgtggcccctttccatcttcaagagagatggaattaatgatggatggaccctggagggaatctccccagcccgactttcactgggctgacagactttgctgaccacaggggaacnatgttcntttcttttcttcatgatcagacntaaacctagcntcnttaatggaagaaaaatgaagggggaacttcaattatganttattcaacgaccaantttntattacncccctccttttatgaccaagntgaccatttnnnatgttanngttaaaaaacctttcccttgcccttnt

SEQ ID NO: 3726 - DNA, 760 bp, Homo sapiens
  misc_feature (1)...(760): n = A,T,C or G
gnnnnttnnnnnnnnnnnnttttnannatacagctcttgttctttttgcaggatcccatcgattcgctgacaagtctgaaatacatattggagcctggtagactgaaaactcaagcaagagttgatgttaaagtcttcagtctgaaatttgtagggcaggagattaggctggaaactcaggcagaatttctgtgttacaatcttgaggcataattcttctccaaaaaaatctccatttttttctcttaaagccttggatgagccttggatgattggatgaggactacccacattatctagggtaatctcctttgcttaaagtaaactcactgtgttaatcacatcaacaaaataccttcacagctacatgtagtgtttgaccaaacaactaggcaccatagcctagccacataaaattactatcattatactttttcttatcacatacttctaccttggaagggatatttcccagttggtatagctacaaaacagaggcagatcatttagcctgcatttgatttgtagtgaaaaataagcctttggtgtgtttaaccactgaaatgttgcggtttattagtatagcacaacttatcctatactggccaacatagatgctttcggttgcaagtaacagatccccttacagtttacaaaaaaaaaaaaaaaaactcgagccttagactatagnagtcgattcgtagatccagacatgatagatcatgatgagtttggacaaccacacttgatgcagtgaaaa

SEQ ID NO: 3727 - DNA, 780 bp, Homo sapiens
  misc_feature (1)...(780): n = A,T,C or G
aaacgcttggnnnnncnnnnncctttttnggatacagnttctangacaanagctacttgttctttttgcaggatcccatcgattcgaattcggcacgagacttttttaacgaatgggggaagggatctatgagaaaggtggtatctaatttttttatggaccataaaggtttaaaagaaaataggggcacaggctgttgaggtttttatgttgttatagacctttttaaattatgttagagatgtntataggnatttaaaggtcactgggagcgtttctgattcccggccacactttgcatttcaacactcagcccggaaagatgctcgttcggntgttggacctctttcactccctgcgtgtaagaaggtgaatcacgtgggaaaaagtgatccttagcaacgtgccaggacacttcctgtgtgcctgcagttgtcanggaccatttgggatcccgaatctcattctctaaaactgctttcttgaaacatgttacttccttagtataatcaatgtatactcccttactggcctgaaacgttgtatagctacttattcagatactgaagaccaacggactgaanaaaagaacaaacattagctattttatgctgcaagaaccaggacacacaattcgccaatcatcccaccatataaccttcgattggngcttctcaactccaccccataatttcttccagagaccatctatcancttttccccaaagaagaaacaaaaccngttgcaccttaaaccatggatattttttcctcangggc

SEQ ID NO: 3728 - DNA, 774 bp, Homo sapiens
  misc_feature (1)...(774): n = A,T,C or G
tnggcnnnnngnnngnnnntttnnntatacagtacngaagctctttgnaatnncnctttttgcaggatcccatcgattcgaattcggcacgagatatgctgaggtcctggcctccagtacnttagaatgtgactgtatttggagatggagatacagccttcaaagaggtgagtaagttaaactgaggttgttaagatgggcccgcaaccaatctcaccggcatccttagaagaaaaggagttggagacacagagagagaggctagacacaggcacacgtgaagggacggtcaggggaagcggcagcgagagggtgctgtctacagccacagagaggcccctgaggagaccaacgctgccggcaccatgatactggactgacttaccgnctccagaactgtcgaaaagacatttctgttgnttaacaaaatagcagtctgtagtacttcgttctggcagcccaagcagactaatgtatagggcattagattgggcgtaagtaaaatataaaggaacttaagtattgaatagtgcaggtgctgtgaggagggatacattgngttntgntattggtcatacagagctagctgntacctgaggcttcacaatgtaggntctactctaatgctgctgcttaaaaaaccccaggccgggcatggggtggctcacgcctgtaatcccagcactttaggaagccgangcgggcggatcacgaggtcanganggcnagatcaacctggccaacatggngaaaccctgtctntactnaaaanac

SEQ ID NO: 3729 - DNA, 779 bp, Homo sapiens
  misc_feature (1)...(779): n = A,T,C or G
taatgcttggnnnnnnnnnngnnnttnaaacnnagtttcaaatcgctnggctatcgcctttctgcagatcccatcgattcgcgaggccagttccaggcccactttttgccctgtgagccccctgcattnctggnttntccttttncaggctgctnctcngtggagcttctctatttnacntctactactgtatccatgnctntagnnggncctntcagtgatgtngcttatntccccaatgacactgatgggagctncttaagaacangctgtntacggacaaggatgtgaagtggtacaagggaaaagtangccgnttaggacctgtgggtgtgtcatgactgtgcttgtatctcttgntagctttgtggccttaggttcaatgctgaccctttctgaggctcaagtttccttatctttaaaataggtattaaaggaagtaatccggtccatacctgagcctgggtatgccctcctcccggacgttcctgttttctgatcgtcttcagcacagacatgagtaaagtgacaatgaccagtcctgtgacttactgagggcaaggtgttccaattcagattgtatactgataattacacagggaaataagagaaganacaagttanaagcctgnagattatagatgtttttgaagaatacattnttttgcattaataaatgtgaccagtttttaaaaagttttcagtattagaggaaatagccacccccatactacttctactactgcaattactatttagcaatttttattntttctttn

SEQ ID NO: 3730 - DNA, 757 bp, Homo sapiens
  misc_feature (1)...(757): n = A,T,C or G
gnntttnnatnccccncttgcaaancntnggctacttgttctttttgcaggacccatcgattcgaattcggcacgagccggacagagagcgcaggagccgcggtaccccggcttcgtgctggggctggatgtgnggcagttctgtgatccgctgccacgtctatgaccgggcggcgcngggtctgcgggttccagcgtgcanaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagtagagacagggtttcatcatgttggtcaggttggtcttgaactcctagcctcacgtgatccgccacctcagcctccaaaatgctggtattacaggttcatgcatccaggagcatatgcaagatactgaacagttccgcactacaaagatctcttgngttggtcttctgtaactatatctaccactctnctatacacctcctaccctctctcattcctagctcctggcaaccactaatctgtcctccatttaaaaaatgttctaatttgaaaaatgtatattcatagga

SEQ ID NO: 3731 - DNA, 798 bp, Homo sapiens
  misc_feature (1)...(798): n = A,T,C or G
ggnnnttnnattccccccctttgcaaatcnataggctactngttctttttgcaggaatcccatcgattcgtgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtgtcatctgtccaggctaactgcccacacatccttctgcaaagggtacctcttggttatcagtgctcactgatccctatataatcagactctaatccctgtaaaaagattacttggtgctagccaagctagcacctttgggtcttcccaaacatacaccactaatccagactctaataacttcatttcctttaaattacaagatcagagctgaaataggccttagaaagctagtctgggctgggcgcaatggctcaagggaggcggaggttgcagtgagccaaagactgcgccactgcactccagcctgggcaacagagcangacttcatcttgcaaaaaaataaattanatnaattaaaaatntgaacctatatgggatttaacctcttcttctcaattaaaagttattttaaaaaaaatggcaaaaaaanannanngnnaanaaaaaaaaacttcngacccttttnaaactnttangnggggtccnnatttaccggtagaatccnagnn

SEQ ID NO: 3732 - DNA, 766 bp, Homo sapiens
  misc_feature (1)...(766): n = A,T,C or G
ggnnntttnaannccntnnttgcaaatcgcnaggctactcgttctttntgcaggatcccatcgattcgaattcggcacgagnaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagccaagggtttcttctggattgagtgctgtccagaaagtggattgagtgctgcagaaagtgggagtgattttgcactggggancttaatttttatgttgtgggtgggang

SEQ ID NO: 3733 - DNA, 737 bp, Homo sapiens
  misc_feature (1)...(737): n = A,T,C or G
aaatcnncagctacttgttctttttgcaggatcccatcgattcgaattcggcacgagggaaaactgctaaattaaaatactacattttacggaaactgtggagctgcctccttgatagaatgttaggtctgtttttgttgtcttctgcctatgtctcttgacttgtagtttcttttgtttcaaatcactctgccctcgtatatactttggttagactacttttggtgaagcactctccaatagaagaacataatgtggtgtcaattgtgtagggatcgcccaagcgttgtctagcatttctgctccccagcagaagccattttatccagccagagttgtccttcacagttctagcatagtctaaactcattttctcattgttcatattctttctctcccacccactctgtcttccctggcaattcaagttaaattccatctctcttctttgagttgctcccctgaagtaagatttctgtttcttctggcattttacctctaaatttatcaataacatgtttattctgctgttcttaatgtcgtgtgtgtgtgtgtgtgtgtgtgtgtgtgagtgattttaatcttctcttgaatttagaagatgagaatttagtctttctcctttccccattcctacattactcctaaattgaatctttaatataaaatcatttattttagtttccagtgtcatcataattttaccttttttctactcaggactataattcccagca

SEQ ID NO: 3734 - DNA, 743 bp, Homo sapiens
  misc_feature (1)...(743): n = A,T,C or G
aaatcnnnaggctactngttctttttgcaggatcccatcgattcgaattcggcacgagggtnaatnntngtttganatcatgcccngatnngacntcaagcnatnaaggaactgcctnaatttgccactggagaaaatcttcctcgagtggcagatntactaacncagcttttgcnnacnggtaagggatattatnnntaccttttnctctaaatatntatcntctttctnaaatgttgactctggatttaggttnnaaatggggtgcagganagctggaggncctncctctgatngagantaaatcccctactntcattcagacgntaaagngaaatgattnctggttatctaatncctggngntgttttggatntaataccctcntgaaggngnaatgactanattcttntgggcatntnagatgtntnntaattnttcncccnatnnnctgnagtatcataatcgnagcatcttaatgaaagttttcaggcatgccagatcnggatctcaancttacaangaacacgtatctntgtgggcttgagggaatggcttagntgataagcatcctgtcaatgtaacctngataaactnagtagnntnacgttgnnaaactgangcanntgatattcaaatnagnaacntattcattgtgccnctntttctttactccanatgactcttgcanaattgaaccnagtggacaacgccctattaagggtgtcccananggatgccaa

SEQ ID NO: 3735 - DNA, 743 bp, Homo sapiens
  misc_feature (1)...(743): n = A,T,C or G
ananctacangctacttgttctttttgcaggatcccatcgattcgaattcggcacgaggctcagtgttgtaattccctattctagcactctcaaaagtaccccatctgttacacatgcagaaactgcagcagcatctgaaatgtccacttcttgattcattctgaactcccttaagcccagtgtttgttagttctcgttcaagtctaggaactctgccgagtaacaggtatctcaattttgccatcctttctttctgcatagacaggagtgttcttaaatcttctcctgtaaagcaagtcatctctgatttccctgaggatcattgctcccgtatactgttgttggggtgagccttctggtagaggggaagagaatttggtactagggttgatagtcaagttactaaggttctttatcaacatctcagagcagaagttttgagaggcccctgaatcgtcctgggaattttcttcagtgagcatttttgaagactgggaccagggttggattaaacttttgtgatgggtccattgtgtctcaacacaacactgagcttctcctggatctttgaaacccagcagaaactgttgctggactctcaaattgccacaaggtagaccagaaagagcctgaaaacccgaactccaaccatctttttctttcctttttaatgcagacatggtgttgctatgttgcagtgagcccgagatcgcaccactacactccacctggcgacagagcg

SEQ ID NO: 3736 - DNA, 748 bp, Homo sapiens
  misc_feature (1)...(748): n = A,T,C or G
aaatcgctnggctactcgttctttttgcaggatcccatcgattcgaattcggcacgaggtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacatgaaaaatcttacactggagagaaaccctatgagtgtaagcaatgtgggaaagcctttatttctttcacttcttttcgataacatgaaaggactcacactggagagaaaccctatgagtgtaagcaatgtggaaaaaccttcagatctacctcacaccttcgaaaacatggtaggactcacactggatagaaaccaaagcaggtgaatcacctgaggtcaggagttcaagactggcctgatcaatatgatgaaacccctgtctcttctaaaactacaaaaatttggccaggcgtggtggcctggcttctgnaatcctagctagttgggaaggctggcacaggagaatcgcttggatcttggggggcanagg

SEQ ID NO: 3737 - DNA, 768 bp, Homo sapiens
  misc_feature (1)...(768): n = A,T,C or G
ggnntttcaaanccgnnttcaaancnagctcttgttctttttgcaggatccctcgattcgaattcggcacgaggttttttaaagaacttgataaatttaccttaaaatttaaataaagtatactgaataactaagtcaacttagaaaaaaaaaagtgttatctaagacaagttacaaagccatcaccaaagcccatgatccggcagacgactacaagcatagggtcagatccatctataaatgagagcctgacatacttcatctatagcaaacatgggagacaaatcagtggtaaaatgatacagtgtttgggaagtgttatttgaaagatgggcttatttaatgtatacagatgaactcaattcctctgtaatagaaacttgttctccagagagattatagatctaaatgcaatgaagaaaataccactataaatttagtactctttattgtaattatccccaatggttatttttactttctcacttcttagatgattttccaagtttgtctagtatctgagttaaaacaaaatttttaactttcttataaaacatagcgtgcccccattttagttcattttctacatagaaataaataaaacacttagataacagttcagaaatagttaattaaatatatcccagattccccacgatctggaaaaattatatcttcaaaatacttctgtctggtggatatgtgtcttctaaaaaaaaaaannnnnnnaaaaaaaaaaacttcggncctntagaactttagggngtc

SEQ ID NO: 3738 - DNA, 770 bp, Homo sapiens
  misc_feature (1)...(770): n = A,T,C or G
gnnnnnnnnntttnnnnntttgaanccctttgctctngntctttttgcaggatcccatcgattcgtgacgagcgactgtagacgttgccagcatgtattgatcaggagcagcctgtgagtcaagactgacaacagatcaataaatggcttttaaaaagcaaaacccctcaagctgtttatctaggaagcctgacaaaccctgcccgcagtggtgtggccccatgtgtccccagggcctggggcccacctctgccccagaagtcctcttagtgtctgtagacaggtcccatttccaccaggtcaaccagggctgtggcagtggacctggatggcaggcagagcagaggaccgctgttctatttgttgaagcaacgaggcacagtgactgttctagcacagctggctgtgagaaatggcgatgatggatccactttagatccgaagtcttagcaaactcaggcctcttttccacagagaatgttgtgaagacctgggaatgagctgttgatgtgcatttttaggatgacagcataatggagaaaattggaagtagcatatgccaaagtatgaagtgttcacacagctcccttgggttggtgatttatgggaagcttttttctcctttatacttttatctactttctaaatctgtcaatatgcttgngtcttctatgaacaagaaagaaaagtttaaaaaaaaannnnnnnnnnnnnnnnnnnnaaaaaaactngagcctttaaactntnggggncgnttacctaaatccann

SEQ ID NO: 3739 - DNA, 783 bp, Homo sapiens
  misc_feature (1)...(783): n = A,T,C or G
ggnnnnnnnnnnttngggcananggaaacccntangcaancnactganagaacccttgggaaggaccccancgaancgaangcggcacgagacanacagnnnannanttacacaccggggntgggngangaataangaggannnaangagcccnctnccgaggnngcccnaagncngcagaagacaaaganccnggnnccaggccangaaaggactgaagnaaananngnaaanaagnacagcngaccctngaacaacanggaggnnaggggnncagnngaaaancngcatgnaagnggaccngngcagnccaaaccngagngnaacngcngaatnaaaggggcnnccnncngcncanaganagnacccanatnnacaaacatgctagagaaaagcaacnggggnaaaacnngcccccactagagaaanggacaggagggannaagncacnnggaaaganaganagcagaactaagcnnggnaaaagcccangaaaggnngganacnanaaagnagccaaaacnacncnagcaaagcannnnaaggcagaaaacnggggcaanagnaacnaacncngggngccaccnaaaaannncanaacagggnaagaancacannnnnnacancangcaaaccanccnnacagagggagcnnaccnngggaagagcnnnnaaanggnacaggncannnnagaagagnaanaccnncaggcaaaangggacccaagggacanagaaanacaaannnggnnnnncacacacngaaaaaaanngaagcaaaac

SEQ ID NO: 3740 - DNA, 756 bp, Homo sapiens
  misc_feature (1)...(756): n = A,T,C or G
ttatanatacagctcttgttctttttgcaggatcccatcgattcgttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagancgtgtgcanggcaaagtgcccgtcactgggaactgcaccagatgctcagacttggttgncttatgtttaccaataaataaaagtagactttttctaaaaaaaaaaaaaaaaaa

SEQ ID NO: 3741 - DNA, 741 bp, Homo sapiens
  misc_feature (1)...(741): n = A,T,C or G
tnaatatacagctcttgttctttttgcaggatccctcgattcgaattcggcacgagactctctctacaactgacagagtaaatagacaaaaaatgtatgggggatatggaatattttatcaacacaagtaaaaagcttgatctaacaggtgggtgggccattctancnaccannngaccngnatntaaancnnatnangntncatccanattcattgttgcntntnnnntantgatntctgtntnanttntcanntntacantnnancnntnntnnnacnnaacagncactannaggtcnannnagctnnaattnannnctntnannccntnncntcnntnattntnnntnnntntnncnanactnttncantatnatanngnatcntntactnttnntnnnnnantancnnnnnanngnnttntntntactanngnncctanttnannnatcnnnntntntacatctntnctactnatnatnnncanntnatatatnntnntnnnatnaaaggantnntntncnnantncntnnnnananatnctnatnnnccntannnnntnannttnnnnaanannatnnnancnnttannnnnnnnnnnnannnttannnnnnnntnnntnttnnnntnnntnnnnnnnnnnnaannggnanannnnnttnnnncaattnntnnnnannnnnnnnnttannnnnnnantannnnatnntnnnnnnantnannaantttnannttnan

SEQ ID NO: 3742 - DNA, 745 bp, Homo sapiens
  misc_feature (1)...(745): n = A,T,C or G
atacagctcttgttctttttgcaggatcccatcgattcgaattcggcacgaggaccacctacggaaaactgaggcccacataagctcgattggttgtacctccaacagatatttattaagcacctactaaatactgagcccattgcaagcaccagggaagcctctgtgaacagcacaaggtccctgctctggagattctgcttcagtggtggagacagaaaataaacagtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgnctttgccattattctcggggctttcatagcagctgggtctgaccttgcttttaacttagaangctatatttttggattcctgaatgatatcttcacagcagcaaatggagtttataccaaacagaaaatggccccaaggactagggaaatacgggtacttttctacaatgnctgcttcatgaatatccaactcttattantagngcttcactggagaactgc

SEQ ID NO: 3743 - DNA, 754 bp, Homo sapiens
  misc_feature (1)...(754): n = A,T,C or G
tnagatcagctcttgttctttttgcaggatccctcgattcggtacaactcttaaagctttctacattttacatatacagtcatctctcagcatcccgaggaagattggttccaggatgggctcaaggtcctgatataaaattgcgtagtatttgtatataacctatgtacatcttctcgtattctttaatctctagattacttataatacctgatactatgtagatgctatgtaaataattgttatactgtattattttcaaattgttttattgctatttttattgcttttccctgaaatatttttaatccacagtaggcggatgcagaacctctttatacggagggtcgactgtgtaggagtgagctagtttcagttaaagcagcggtggttggtactcatctctcacctgcccccacgtagtgtagctagggcatcagggagtactgatctctggcatcatctgggatcaacaggattttcctgcctcacaggcctgtgagcacattagaaatacacctgctcagctcaagtcaaagtgagaagcttttgaatggagtgataaccgagtaggcagtatctaaataaagatgattggttcaagtctcagtggacaaatgtgtaccgttctattactgntgactgtgactttgaagtatatggngttcattaagcaaatccaatctgatcgtatgaaaagagcaccccaaaaaccaaaatgaaaccatttatcaggacttttgnagctatgaaa

SEQ ID NO: 3744 - DNA, 752 bp, Homo sapiens
  misc_feature (1)...(752): n = A,T,C or G
tnagatcagctcttgttctttttgcaggatcccatcgattcgaattcggcacgagctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggtgggacatggacacagctcaaaaaggcagtgcctgccttactcctctggcttggaccactcagccttaagcgggacaataaccccctgacacttaaccctgtgttgagctatggggccatctctagcagagtcaagtcaaaacaggggactctgcacaactgttattcagtgagtgtgaaaagtcttagcctagatcccaaatcactgccctcaccagcaaaggcatgtttcattccttctgccaaaacatgcagcagaatcggatagtggttaagagcatgtctctggaatgagatgctcagtgtgagtcttgtgtggccttgggcatattgcttagagtctgcttccacgcgcctccctacctggcctgggatggtgtccagcttctgacccanctgctggtccattcagagttgttactacaagggccaggaagtaaccatggtgcaaatcctatagttgaaccccaaatagatgatgaaagaagaaaaannnnnaaaaaaaaactcgagcctntaaaactatagtgagtcgtt

SEQ ID NO: 3745 - DNA, 770 bp, Homo sapiens
  misc_feature (1)...(770): n = A,T,C or G
gnnnnnnnnnttngnnntntgaagccnttantganttcccttttttgcaggatcccatcgattcgcagcatccacatgacaggcggcgccgaagggatcctgcccctgactttcatnagctgttgaaccatctggaattcacaggcctgtcatgagagacacgatgagaagtccttaaaggtagatcactgattcacaggggagcaggcggaggcaagggtgagtcagtgcttggaactcagtcatccagatttggctctggaaacttctgaagctgtagcctttggggatccctgactgcgagtacaggaagccaacgctatgtggtcttctggaaactcattatctttttcactggtgctatctgggaaaaacagatgaaaacctgaaggtgttctgtatgtgtgctttcaaaagcaaggatctggccggacgcagtggctcaggcctgtaatcccagcactttgggaggccgaggcaggaggatcacctgaggtcaggagtttgagaccagcttggccaacatggcgaaaccatctctactaaaagtcaaaaattatctgggtgtggtggtgggcacctgtaatcacagctactcaagtagctgaggcagaagaatcagttgaacccaggaggcanaggttgcantgagcagagatcacaccactgnacttcaacctgggtgacaagaatgaaactccgtctcaaaaaaaaaaaaaaaaaaactcgacctttaaactatagtgagtcgtattacgtanatccagann

SEQ ID NO: 3746 - DNA, 776 bp, Homo sapiens
  misc_feature (1)...(776): n = A,T,C or G
gnnnnttnnnnnnnncnnntttcnaatagnnagctacttgttctttttgcagggatcccatcgattcgaattcggcacgaggctatgtgttctgactttgttgattcaaataagtaagctaaatcaatttaagccattaataggtttataaagttatttgctatgtgttgttcttacatcattgattcatgtaagtagacttgtgtgacagctaattcttaaaaaattatgaagatgttagacttcttttgatatatatatgttgattgtatgaacagattgacatcaatatacttattcattataaaagatttgagtgggaactcaccaaatcccacaccaaaaaaatttaaaattttaccatagtaaaaaaaactaaaaagcaagatgaaattatacatagttcttggtgtagtatttttaatttttattatttatttttatagaaatggggtctcaccattttgccaggctgttctcaaactcctggcctcaggtgatccgcctgcctcgacctcccaaagagccaggattataggcatgagctaccatgcccggctagtgtagtatttttaaattttacttaatgctgagccattttcaaataacctcatcacattgattatgacctcatgcaagaaccatctggtctatctttcagtgtagttgtctttaatatcttagaactattgcattctgnccttttttgggaatggtttatgcttttacagtcttaaccattgcttcttaatatcactttccgcggnacaactggg

SEQ ID NO: 3747 - DNA, 960 bp, Homo sapiens
  misc_feature (1)...(960): n = A,T,C or G
tannnnncnnnnnnnnnnnnnnnnnnnnannnncnnnnncnnacnnnnaggnncnnnnntcnnnnnnnnnnnnnnnnnnnnnnnnntcnnnnnntnnnnnnnangtanntnnnntntnnnnnnnnannanngngngnnantttnccaaaatacccnagttttctaaaatnccttgggcnnaatccgcatctcgcngcaaggcgacccntcgnattccgnaattcggcnacgaggggcaaggagtatngantttcattcaggaattttnttcangcaatttnatcaatcttattcttgaattntattcaccaataatggctcgccatngangagtntaaagtnaggaaacanngctatccttattcacattttgcaaagttcctccatgggctactatgatgantaatcaangncaangnggaggtaanaagtgaactnggganactngttgaccaccncactcaatcccncngatantggcaccatntactnanggnnnnacnnatcnnnatnacattaagaggatgnttacncctgatatgttgactggcttgttggaaggacctatagctggaacatgcttccattgccaagaaaggagctacaggtnaagagacactagntnaccntatgatngccggnttccagcctggcataatggnganttgcnnntgacntnaatagcatntcntgcnacaatngaactnncaagatagaanaagcaanngcaagggaatcnttgcntgctttaacccttactcatcnaaanggcctctcntactncaaagaatttacanatccngcttaccatttatcaacnccaatgctgcttaccgtnggtnaaccacccaannttgnctttaaaataaccacaangtntncnaaaangccnaaactcnnancctntagaactataagtnnntcaagatccctatnatccatncttgataaatanacgnn

SEQ ID NO: 3748 - DNA, 758 bp, Homo sapiens
  misc_feature (1)...(758): n = A,T,C or G
ttnnnaatnnncantctcttgttctttttgcagggatcccatcgattcgaattcggcacgaggtgacacagagacagagaaacctcccccacccagggaagcagctctgcagagttggcaggatcaggggctagtctgaacccctagcacagaacactcacctcacggaagagtggccagaatgttttccacataggtcctggtcctcacttctcctcactgagcagggctgcccaacgtgggacttctgcacaaccatcctgcccctgcctgaccacttcaatcagaggcagcctggcagttaaaggaacacccacacacagaggtgaaaaagaaccaattcaagaactccagcaacacaaatgaccagaatgtcttatgtccttcaaatgattacactacttctccaacaaggttcttaatcaagttgagttggctaaaatgacagaaatagaattcagaatatggataggaacacagatgaccaagattcaggagaatggcaaaacccaatccaaggaaactaagaataataataaaatgatacagaagcagaaagacaaaatagcctatataaaaaataatataactgatctgatagagatgaaaaaccaagctgaggaaagaatcttggaactggaagactggctctgtgaaataagacaggaaaaaaaaaaaaagaannnnnnaaaaaaaaaactcgagcctttagaactatagtgagtcgtatacgtagatccagacatgataagatcctt

SEQ ID NO: 3749 - DNA, 771 bp, Homo sapiens
  misc_feature (1)...(771): n = A,T,C or G
gnnnttnnnnnngnnnntttaaaatacagctcttgttctttttgcaggatcccatcgattcgctgtagtcctattttgccatatgacatgattgaaatcaacacctcttagaaatagttttgctgcctcataattgattaccatcatgataacctgtagtcagtgtgaaatagagataaaaattaatgtacttagttaaatgcatatgaaggtctaatcttgttccagagttactcttactggattatttttagatttttattaacattactggtctctaactttactcagtctggataagaaaaagaataccatgcaattgttaactatttgatgtttactagattaactattaatatattgttgtggtccatatttaagagttactttgttactagagatttcattatagtggtgtttaatatagttttgggtatttttaactaaaaatcattgttatccttcaactgtagattctactatgaaatgaggaaaaatcagcaatagaattaattgggttcaaagtatataaataatgatgtgggaaagggaagtcagagggtatctctggaagaactgatttatctgaaggtaatactgagtgaaagaacctaagattgtagacaaagcatgctttatgcaattttgctggtcatagtagtagtagaggctctataaatgtgttgggtgtttttggttttaaagagacagtgtctcgctatattgccccaggagtttaaagctgcagtgccctgtggttgcacctgtgaa

SEQ ID NO: 3750 - DNA, 766 bp, Homo sapiens
  misc_feature (1)...(766): n = A,T,C or G
tgnnngtttcnaatagnnagctcttgttctttttgcagggatcccatcgattcgaattcggcacgaggtgaattcctcagcaccaagttgtttaacacagaagagaggtggaaacaaaaaatgcttggtttttactggctttcttttagcatttctgtctagtcgaaatgggggccaggcttgcacacatagacaactgaattaatgtaaccggacctattccatctaggctgacctcttgaaagataggaggggaagtctaaaacaggagaaaagttttagaaatcctttggattaggcttacccagattagtggtatgtaaaatattatgatattcttagtgtttcaggattatggattttagtaaaagcagaaaaaaataaattcttgtttaactgaatctataatggcaccagtggtttggaaacatttctgagttacttgattttatgtgaaaaaatctggaataacttttccttttttcctttagaccatttttcttttatttaacctaatccgagccactttataccaatttcaacaatatttctgaattcctgtgatcttttatttcctttttgctgctttcagctgtgtttctctccactctaagctcattaaagttaaaaaaaaaataggagattggacccatttttttttctgaggagtgtggccgtttaacaccctgtggtggctcaggatattttaagtagtattttcagctttctagaantggttgncttanttagnaaatagttatnggaa

SEQ ID NO: 3751 - DNA, 771 bp, Homo sapiens
  misc_feature (1)...(771): n = A,T,C or G
aggctncttgnnnnctantgaagcctttgctactagctnagctcttgttctttttgcaggnacccatcgattcgaattcggcacgaggcatagttggaagttaaggttgaaaagagagataggggaaaacaggtggaataatattgaaaattggatcaagaatataggtgtaggcgttagccattttatcctgggagaagggaggaaatgaaatanaaacaggaatagatagacgttttgaggcgaaaggaatgaatccagcatgctctgtttagtgatgtagatgagatcacctgggaaggcatgaatgggcgggcagagtggggtagtgacttcagaagagtaataagggttgaaaagcactgctgggtgagggggaaggaatgtccataacctgactccagcttcctttagaataattaacacacgttacactccttatttaaacagagatcccaagatcagataaatccataattacttatttgttgtacccacaaaatactataggggtctgcttactttctcttgaaagcatccccttggtaattattcttttatgtttctctaattgcatgctngagaaagcatctgttagatgcaactagtctttagaccctgaacacctgcagatcttgttgatgcatgcccaagttcagaaagctctgaaagaagttgctttaaagangataggccatggcttttcagatacngaccttgaatctgtagtggttcctangtttccaatcctaacattacccacttggtaag

SEQ ID NO: 3752 - DNA, 747 bp, Homo sapiens; identical to SEQ ID NO: 3558
  misc_feature (1)...(747): n = A,T,C or G

SEQ ID NO: 3753 - DNA, 683 bp, Homo sapiens
  misc_feature (1)...(683): n = A,T,C or G
ggatgaacatggcatcatatgattagaaaaccaaaattcatttttgatggctgttgtggncagatcgtgtcctctaaaatttatgtgctggaaacttaatttctagtgttaacagtgccgagaggtaggggctttgggaaagtttaatggattaatgcccacatataagggcttgttggagggaatttgggctctttgttgccccttccatcctttctaccatgtgaggacgccacactcctcccctttggaagatgcagcaaacaaggtgccatcttggaagcaaagactaagctcttaccacacatcgaacctgttggtgccctgatcttggactcccagcctacagaactgtgaggaagttaagtttctgttatttataaaattaccaagtntcaggtattgtgtnatagcaccataaatggactaaanacaatgccaaaggtggcacttgccatanaactgctgccgatgatatcaactctttgctttccagagttaaagctttggattctgatggggttgattctcttttgtgtnggacccttgtactggttnctattataatagttcttttctaatntttaagccgggccccnatggctcatgcctttaatcccagcactttggggaaggccaaggccnggccnattcaccaggtccaggagntcaagaccatncnn

SEQ ID NO: 3754 - DNA, 752 bp, Homo sapiens
  misc_feature (1)...(752): n = A,T,C or G
tcagctcttgttctttntgcaggatcccatcgattcggctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggtcagctgactttcacgatctcaggtactgatgaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccacctgccagcatggagaaaccccgtctctactaaaaatncaaaattagcccggcatggtggcacatgcctgtaatncangctacctgggaggctnangccgggagaattgcttgaaccccgggaggcaaaggttgtaattgagccct

SEQ ID NO: 3755 - DNA, 760 bp, Homo sapiens
  misc_feature (1)...(760): n = A,T,C or G
naatancagctcttgttctttntgcaggatccctctnttcgaattcggcacgagtatcacagtttgtaaacgggtgtttttgtccttgttattgaagtatacaactctgcttagccaaacataccaagcaacagacagaagcgtcacttggagagaagaagaaagggttaactggcagagctactgtaaaagaaggatagaggagggtaagtttgaaagtggccatgggcaagaattttctccagatagctcttgattataatctctctcacctggattatttcccatctcctgacagtttgttctcacataactatcagcagtcctctcaacacagaatcagaccatgtctctcctctgctccaaccctctgaggctctccatctccctctggataacaccctgcatgacctggccctcctatcccactgctcctcaccgcgctcattccaactctcctgttctccttgctatttttcatatgggccaagcaagcacgtgcctcacaacttgtgctcttggcgtctgtctgcctgaaactttcttgcctcaggtagtctcatggtttatgccctctcctctttcaagacttggttcaagtgtcaccatctctgtgaggccttctcagatcacctagtcctgacacatactagccttctttcctactttctncactgnactcatcatctgctaatgngctactggttgcatattgcatttaatgnctgtcccgttggtcatgctggtttgggggnggggg

SEQ ID NO: 3756 - DNA, 756 bp, Homo sapiens
  misc_feature (1)...(756): n = A,T,C or G
ttncnaanatcagctcttgttctttntgcggatccctttntncganttcggcacgagggaatgtcaggcctctgagcccaagccaagccatcgcatcccctgtgacttgcatgtatacgctcagatgggcctgaagtaactgaagaatcacaaaagaagtgaaaaggccctgccccgcttaactgatgacattccaccattgtgatttgttcctgccccaccttaactgagtgattaaccctgtgaatttccttctcctggctcagaagctcccccactgagcaccttgtgacccccgccctgcccaccagagaacaaccccctttgactaattttccattaccttcccaaatcctataagatggccccacccttatctcccttcgctgactctcttttcggactcagcccacctgcacccaggtgaaataaatagctttattgctcacacaaaaaaaaaaaaaaaaaaaaggataacaacctgcttggcaagtttgaactcacaggcatacctcctgcaccccgaggtgttcctcagattgaagtcacttttgacattgatgccaatggtatcctcaatgnctctgctgtggacaagagtacgggaaaagagaacaagattctatcactaatgacaagggccgttgacaaggaagacattgaacgtatggccangaagctgagaagtccaaagctgaagatgagaagcnnanggacaagngtatncaagaattacttggtctatgcttcaaaaga

SEQ ID NO: 3757 - DNA, 763 bp, Homo sapiens
  misc_feature (1)...(763): n = A,T,C or G
tnnannatcagctcttgttctttttgcggatccctctattcgctcagaaccactctgtcgtttttaagcagggtcacacactctagctcactgggtccattttaatttctattaaacattttttttttttgcaaatgatgtagtaggagatccaaggtgtttggttaatgatttattcactcattagtcattccacaaacttgtcttgagcacctgttatgtacccagcactgtgctggaatgctgaggagacaggagtgaagtaaaaagacatggttccggcaggaaacaggcaaggagagccttgacttgacggagtctggctatatcgccaggctggaatgcaatggcgcgatctctcctcactgcaacctccgcctcccgggttcaagcgattctcctgcctcagcacctcgagtagctgggactacaggcgcgcgccaccacgcccagatgagaaaactgaggcacagagaggtgaaataagtgagatgctacctacctatgcagagctggaaaagattttgcaacctgaaaacccaatcctttctgagatataaaagaacagaagagtctggaagtgatttcttcggagaaattcattttcttattccagagaagaaacttcaagctcagaatattggctactacctgngataaacatttaaattattgggaaccagagagtttttatactaaattgnaaagaacaatttttttatcaaagaccaancccgaaattcttgaccctcctgggatttca

SEQ ID NO: 3758 - DNA, 806 bp, Homo sapiens
  misc_feature (1)...(806): n = A,T,C or G
ttgaagccctgctctngttcttttgcaggatcccttttncgcttcggcacgaggtgtaggcccncatcgtccctcattactcgggtttcatattttgctgnttttgatggacatggaangaatncnagcctcaaaannngctgaacannnttggcatcaaaatttnntcagaaaatttcctaaaggagatnnaatcaagggccnnaanaccgcnaanagatgcctcttgnacactaancaagcatctnntgangagnnncttaaacangcttccagncagaancctgcctggaaagatgggtccactgccacntntgttctggntgtggacnccattnnttatattgccaacctcnnnnatagncgggcaaacttgtgtcgttataatgagganagtcagaaacatgcagccttaagcctcagcaaagagcataatccaactcagtatgangagcgntatgaggatacattaaggctggangaaacgntagggatgggcgtgttgncgggcngtgctatagggttnactctgcatagnggacgtcagaccagnactttcgatttaccctntgatnngccgacatnaganttctgcccngctgacacccaattgacangnttnntttncattnncnttgtatatanggcncttaaanggatttcctcntcnngatnatancctattnnccctnatacntnggtntatnctantnnntnntgcntnanttntcncttganctanctcntaaacnttnggnaantctttttanctctctngtangtcttattctcntantattnccncc

SEQ ID NO: 3759 - DNA, 802 bp, Homo sapiens
  misc_feature (1)...(802): n = A,T,C or G
ttcaaatcccnagcttctaagttctnttgcaggatcccatnnattcgaattcggcacgaggcttcgtgtgctactgcgaaggggaggaaagcggtgagggggaccgcggcggcttcaacctctacgtgaccgacgccgcggagctttggagcacctgcttcacgccggacagcctgncggncctcgtgggtaactgggcgggtctgggagccgtcacacccctccttgcantgcagatcgtctatggggcgacagacatctgggattccccagaaggctctgacaccctctgcccgccctgtagctgnagtcctcccattggctagggctcttggggtcgggcaggtttngggtgcccccagtgggcctcgggttncaggcagctcgtgacaagcccctgngctctctagaaagcccgttntggcctgagtgcngntgaggacatnaccccccggttcaggtgagacccaacagggaggaaggacngatgggnaggangangggtctgccacagctctcccgtaccttttctatnccagggcagcctgtgagcagcaagcctgtggctctgacttctgcacgaangacanaagcnattccttgacgcttttcaaggggggccctaancacttggcctttggacctcttcaangntaccaggccccaataggcnagcccccaangctgangggccgctttacactggggcctnggcaaaaacncgtnttggaaccttgtaacnggnnaactggnaagcttcacnaanaagacaatttnttannnccnngggaaaaagcccccc

SEQ ID NO: 3760 - DNA, 772 bp, Homo sapiens
  misc_feature (1)...(772): n = A,T,C or G
gnnntttnanntancagtttgaaacccttggcggaccctcgattcgaattcggcacgaggtgtttcttctacctcccctgcacaacattgtttatatgcttnctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatatgcaagatagcacgtgtggtttccacatattctaagaggcatcttcaattagattccaaaaaaaaaaaannnnnnnaannnnaaaaaaactcgagcctntaaaactatagngagtccgattcgtagatccngacatgataagaancattgatgaagtttggacaaaccncaacttggaatgccntggaaaaaa

SEQ ID NO: 3761 - DNA, 771 bp, Homo sapiens
  misc_feature (1)...(771): n = A,T,C or G
tttaagancagctcttgttctttttgcggatccatcgattcgaattcggcacgagcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccttccctaaaccatcccgtagtcttctaatacagtctctcagacaaagtgtctctagatggatgtgaactncttaactcatcaagtaaggnggtacttcaagccatgctggcctncttacatcctttttnggaacagagcacngnataaataattaacttaataataatatgcccaaaaaaaaaaaa

SEQ ID NO: 3762 - DNA, 764 bp, Homo sapiens
  misc_feature (1)...(764): n = A,T,C or G
cagctntngttctttttgcggatccctcgattcgggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccaacggaatgctgagtttgtcatgtcccatgggccctttggctccctgcactaatatgtatagtangggtttacaagatatgaaaatatattttactttttttatatcttataaacctcactaccccttccacaatattggttttcatttactatcttgacatagagtttggcttggggaagggggcagttttaaangcttccc

SEQ ID NO: 3763 - DNA, 764 bp, Homo sapiens; identical to SEQ ID NO: 3762
  misc_feature (1)...(764): n = A,T,C or G

SEQ ID NO: 3764 - DNA, 802 bp, Homo sapiens
  misc_feature (1)...(802): n = A,T,C or G
ttctaatgcttggntctcgatctttggtcaggatccctcgattcgctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactccgggctgctgtgtgtggcatgtggttcataccgacggggaaaggcgacctgtggtgatgtcgacgtgctcatcactcacccagatggctggtcccaccggggtatcttcagccgcctccttgacagtcttcggcaggaagggttcctcacaagatgactttggtgagcccanaggagaatggtcagcaacagaagtcttgggggtgtgcccggcttccaaggccatggcggcggaaccgggcgcctggacatcatcgtggtgccctataagcgagttttcctgtgccctgctctaacttacccggcttttgacacttcaaccgcttccatgcnaaccccttgcccaaaaaccaaagggccttgaagttttntcatgaacantgcccttcaaccacttgntgtgggtcccgggaacaacccatgggatnnaaaggnggnggccttgncccaaattgcttnncc

SEQ ID NO: 3765 - DNA, 744 bp, Homo sapiens
  misc_feature (1)...(744): n = A,T,C or G
atacagctcttgttctttttgcaggatccctcgattcgaattcggcacgaggcatatgcttgtctcaaagattaagccatgcatgtctaagtacgcagggcctgagtctntgccctcgtgggcgttgagtgacactgattctcgcgtgtctccggcctctccggcagggagtcctancgcagactttgcggntcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttataagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctgcaacttncagcgagagaatgaagccctgcggtgcggacagggcgccagcctgacccgtggtgaacagaacnccgacgtggccctgcagaacctccgggtggtcatgaacagtgcacagctttcatcaagcactggtttccggagctgagacctgaatcttgttgccaaatccttaaatctattgacngaatttctgaagttaaagaccangaggaagactnttgaggccctggn

SEQ ID NO: 3766 - DNA, 746 bp, Homo sapiens
  misc_feature (1)...(746): n = A,T,C or G
atcagtttcttgcctttntncaggatccctcgattcgaattcggcacgaggtttccctggcttaccgtgatgacgcatttgctgagtggtctgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgnttggtgacatncgacagggcatcttctatgccatgcttctggccttctggatcatcttctgtggcgagcacatgatggatcagcacgaaccggnaccacatngcanggtattggaagccaagtcggcccantgccgtngntcttctgnctttcatatttgacatgtgttaaaaaangggtccaacttacgaatnccttttacagtt

SEQ ID NO: 3767 - DNA, 749 bp, Homo sapiens
  misc_feature (1)...(749): n = A,T,C or G
tnagatacagctcttgttctttttgcaggatccctcgattcgaattcggcacgaggttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgcttcacttattttgaattatagtgcaattttgtggagggtgaaatggggattacacaatatagcgatttcctgttaacacctacatttttgctgatcaagcaaggtctgttggtgcgagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacaggggagaaagtataaaagtgagcccttcaagtgctctagtgtacatgtcagaattnaagcacgagttncacgggatggctcacccccttc

SEQ ID NO: 3768 - DNA, 759 bp, Homo sapiens
  misc_feature (1)...(759): n = A,T,C or G
caaatncnngctctcgttctttntgcaggatccctcgattcgaattcggcacgagggctgcagtgagctgtgatcgtgccactgcactccatcctgggtggcagagtgaggccctgtctcaaaataaataatccagtcccccccaagaaagggaatgaagtgctataatgagaaaaatcctagtacctaacatatagtagacagtggagagtggttctctttcgttnctcaggggcagacagattgggtgctggagtcctctatcaaagagtcagagctctatcccagatgtgtaatgaacgtggtcacagacatattgtccattaccatttaccttccctataaccactgtgcctccagccttgtagaatagacacataggagcgcagcaatacgtctaaaaataggagtgagagagggcagggcatgcccgttcttgnggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagacaaaaactaatggatttntcattttncacagngacaagaattaaataatagtangtctgtcnaaaaaaaacaaaattnaaactcgagcctntagaactttngngagtcgtattacnttagatncagacntgatacgataccatggan

SEQ ID NO: 3769 - DNA, 754 bp, Homo sapiens
  misc_feature (1)...(754): n = A,T,C or G
ttgcnaatgctaggctactcgntctttttgcaggatcccatcgattcgaattcggcacgaggagccaccatgcctggcccatcgtntcatttgatccttgcaacaccctatgagaatatccngatcgaacgatntcacagatnatccatagtgatactcagctaacggntggtctgccaagacttgaacccaccattcttgttactnncttgatnnctttaanactggttatnnnnngccagtntgnnatggngcnnaaaatangatgtnngntttttggangtannanntgctacaggcntnnactntatnatctnagcnatagcnagtncaagtnngactgattnagnatacacnnngnngtgttantngctaaaatattgaaanaactttnattctggntggagcncgtnnngtntcccaaatatgaacaaccaanatctgaaatgctncaaagctggaaacttttagagtgnttntgantgccngccaacatgacatgcaaganaaacattnatttggagcatttnggattgtgnatattnagattngggatgctcantangnattaatgcanatattncaaaanccncgccttcngacccagcngaaanaaaaaccaaaancccanaatacttgngntcnccaagcattcatgaaaaaaatgatncttaacctngnaaatagctttgncccaacccncnnaagtttctttntctacttccctggccantttnaacattaggaaccccct

SEQ ID NO: 3770 - DNA, 752 bp, Homo sapiens; identical to SEQ ID NO: 3754
  misc_feature (1)...(752): n = A,T,C or G

SEQ ID NO: 3771 - DNA, 761 bp, Homo sapiens
  misc_feature (1)...(761): n = A,T,C or G
taaagnatcangntcttgttctttttgcaggatcccatcgattcgctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaacagaggtttttagtttctttaaagggttgtaaacataaaaacaaagaaggatacaacatgcaaggcctaaaatgtttactttctggccttttacacaggcagttcgccagccccctaccctacagtatggaaaaaaggcatagaacagtcaaatcacgtaggatttcttggtttctccatgcaggctcatcgaatagcaaccatcctttcttagtttcttgaaacaagtaccttatttacattcagagaattatatgtggacaaacagctcataagcccgtacttttacatactcacttcctgaattgcatattgaaaaagagagttcatgtaaagcccgattattatttaatctaaagttatgttcacataggaagcactatgtagagaaatagggtctganggacaaggagcct

SEQ ID NO: 3772 - DNA, 761 bp, Homo sapiens; identical to SEQ ID NO: 3771
  misc_feature (1)...(761): n = A,T,C or G

SEQ ID NO: 3773 - DNA, 834 bp, Homo sapiens
  misc_feature (1)...(834): n = A,T,C or G
ggnnnntttnnnatttngncnnannnanaactctnnagnaanccctttgtncaggcatcccatcgattcgaattcggcacgagcagcctgcggccaggctttttatttaatntnaatagtttttgtttgcctccgtggtttggtcaccgtgtgcatcgcaccgtgctgtaaatgtggcagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgcctacccaccttcaggcagcctatgggacgcagggccccatctgtccctcggtcgcccgtgtggccagantggggtcccgncgtccccaacactcgngcttcggnttcagaacacttttgggcanggaangtcttgggggcccttaaccaagcanggaaccnccgtgccaaagcccngggcaaggccgggtcccaaccttaggaaccccaacaagccccctttnggggaagccaacccccnaaacctttttggggggg

SEQ ID NO: 3774 - DNA, 787 bp, Homo sapiens
  misc_feature (1)...(787): n = A,T,C or G
gnnnttttaaatacccagctttcaaatccttgttcncgncttncgcaggatccctcgattcgaattccgttgctgtcggtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaaganaagaagaggagctggctagtcangaacttattcattaaccaccaaacctctacctnttctctccttgactgtcacctgtaggacagtttatcagtcaactacctttcctccagactttacttccaggctctnctcttcagtanctggatgactttagcagaaaggactggtaaatacaagccttgggtttcagaatgaattagaaacaaataactcttactgtcttccctcccagctttgtttattttgtgcttttagacttttcagtgntntcttttttcagnccactgtataaacttggattgtccattcctcctgaagaaatcaagttgggtatttttgatgtggaaaagggaacaanaagtggaaacatggctactttttggggagtggatnttttaaaaaaatnaggttggctatgggcaccaaanttttctacatttgngtnncaaacttcttgtgaaatgtgggattncaaant

SEQ ID NO: 3775 - DNA, 743 bp, Homo sapiens
  misc_feature (1)...(743): n = A,T,C or G
ttnnnnnnnncagctacttgttctttttgcaggatcccatcgattcgaattcggcacgaggctgggtgtggtggcttatgcctgtaatccaaacactttgggaggccaagaagggaggatcacttgagcccaagaatttgagaccagcctgggtaacttagtgagaccctgtttctaaaaataaatagacagatgatagatagtcagatagagagagagagagagatgatatagatatagatagatagatagaatgttctctaccccaagggtggagaaagacttgagcaaagacacagaggccacatggattaaaaggaggaggagaagccctgtgtttgcagggatgaatggcctatgctctggggaggtgggctgtgccctcagcagcatccacatctaatgcaggacaacaccatcgacttcctggagtacgtggcagctctgaatctcgtgctgaggggcaccctggagcacaagctgaagtggacattcaagatctatgataaggatggcaatggctgcatcgacccgcctggagctctcaacattgtggagggaatttaccagctgaagaaagcctgccgcgagagctacaaactgagcaaggccagctgctcacacccgaggaggtcctggacaggatcttnctcctggtggatgagaatggagatggccactgctnttgacnaattggtgaagngcccctcgggccaagtgggtgatgaaaatcttccnatggc

SEQ ID NO: 3776 - DNA, 730 bp, Homo sapiens
  misc_feature (1)...(730): n = A,T,C or G
atcagctcttgttctttttgcaggatcccatcgattcgggagggcaggagagtgaccaagcagctagaagagagggtgcagcaccccaaggnnaggactgggggagtgggtgttccaggaagggctctggcatgtaaagctgcacagaagtcaaatcagataaagcctgagagggatccatgggatttcttggcaaagggattgttggtgataccaggaagagcagcttcagtggctcatggggagagaagccagattacaggagatcagcaactgagagagtgagtggagagcatcttttaagaatgtcttgagtgcgggccggctgcggtggctcacgcctgtaatctcagcactttgggaggccgaggcgggcgaatcacgaggtcaggagttcgagaccagcctggccaacatggtgaaacccgtctctactaaaattacaacaattagctgggcacggcgcantggtgcgtgcctgtaatcccagctctcgggaggctgangcaggagaatcacttagaccagggagtcggaagttgcagtgagctganattgcgccactgcacttcanactggtgacagaactagactctgtcaaaaaaaaaaaaaaaaaaaactcgagcctntagaactatatgagtcnnattcctagatccngacatgataagatncattgatagtttggacaaccacacttgaatgcntgaaaaaatctttatttggaaat

SEQ ID NO: 3777 - DNA, 769 bp, Homo sapiens
  misc_feature (1)...(769): n = A,T,C or G
ggnnnnnnnnnttttnnncnatggaaacttttgctattgcnctttttgcaggatcccatcgattcgaattcggcacgaggccaccaccaccaccagccccacaaaattnacctcaaggcntacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttggtggtggtggtggtctccattgctgntgntgcaaggaaagtcttacttaaaaaaaaaaaaattttgtgagtgactcggngtaaaaccatgtagntttaacagaaccnganggttgtctatggttaaaaagcctntagaactatgngagtcgnattacgta

SEQ ID NO: 3778 - DNA, 743 bp, Homo sapiens
  misc_feature (1)...(743): n = A,T,C or G
naanannagctcttgttctttttgcaggatcccatcgattcgcccacctcggcttcccaaagtactgggattacagacgtgagccaccgcacctggcctaaatttcaccatcgtttctattcataacttacctgcaaagtgattatctgactagtactactgcaacaaagataataaagtgcctgatgtttatatcaaataggatatggcatgtttctgagtgtttctaaagaaaaatactgaatgaacccctcgcctaacctagtgcctgtggtaacaataactgacatgcattgagcgcttactgtgtgccaggtgcttgttcgaggtactttaccggtattaactctttaattcgcataacccttctgtgagatgggtaacattatacccattttacagatgaggaatctgaggcctggagatatcaaatcatgtgcccaaggccacaaagccaacatgtggtagaactgagactcgaatctaggcagtttgttccaatttttgtgctttgaacctgtgcacaatatgactattgctattttgtgatattatttgagatttctcttttaattattcttgatatctttggggcagaaaaacaatgaataataatgttatgaatattaaagcccctcaaaaaaaaaaaannnnnnnnnnnnnnnnnnnnnnnnnnnnnnnnnnnnnnnnnnnnaaaaaaaaaacctggcctttaaaattttggggggnnntttccnnaaanc

SEQ ID NO: 3779 - DNA, 748 bp, Homo sapiens
  misc_feature (1)...(748): n = A,T,C or G
ttntatatcagctcttgttctttttgcaggatccctcgattcgaattcggcacgaggatataatggccangaggaatcanaaacctgacgttagaaaggctcaacgagaacangctatcagggctgctaangaagcaaaaaaggctaagcaagcatctaaaaagactgcaatggctgctgctaaggcacctacaaaggcagcacctanncaaaagattgtgaagcctgtgaaagtttcagnctacaggtggacaatgaggaggaggaaagccnnggacaggttgaagggcggcttgncccatccactgtggtcctggaccacacangcggctttgaggggcttctcctgntggntgatgacctgctgggggtgattggacacagcaactttggcaccatccgntctaccacatgcgtgttcaaagggaaatggctctncnaggtcctcatctctnccangggctcatgcanatcggctggtgcaccatcanctgccgntttaaccangangagggggttggagatacacacaactcctatgcctatgatggcaaccgcntgcncaagtggaatgtgaccacancgaattatgcccccccatctntgctgggttncanncctgtggtcacaagtnctgcngngcctgtatnaaccagcacctgttgaacancanggacttgnttcttcttcaaaaccaccnttntgtctgtanangacttggtanaagggagccaatccnagttctacn

SEQ ID NO: 3780 - DNA, 771 bp, Homo sapiens
  misc_feature (1)...(771): n = A,T,C or G
gnnnnnttnnnnnnnnnnnnttttnaatntcagctacttgttctttttgcaggatcccatcgattcgaattcggcacgagggatttctcctccttccgcgctttctgcgtgacactggctgtcagctctgggctgggctttctgggggccacacagctgctgaggcggcgggttgaggcggcccgaaaggacccagggtgctcagcctggttgtggatagcggcctgtgtggagaggagctgcttgtaggcagtgaggaggcggacagcatcaccttgggccggtatctccggcagctggcacgccatcggaacttcctgtggttcgtgagcatggacctggtgcaggtgcagtggctcacgcctgtaatcccagcacttcgggacgccaaggtggaaagaccgcttgagcccaggagttcgaggctgcaatgagttatgattgcaccactgcactccagcctgggcggcagagaaaggctccatctctaaaaaaagaagagctaagtgctgtacctaaaacatgcagtatataaactggctgaacttagaaataaactgttttcatgttatgaaaaaaaaaannnnnnnnnnnnnnnnnnnnaaaaaaaaaaactcgagcctntanaactatagngagtcntnttacgtanatccagacntgataagatncattgatgagtttggggacaaacccaactngaatgcntgaaaaaaatgctttatttgngaaaatttgggatctatgctttatttgtaccattataagctn

SEQ ID NO: 3781 - DNA, 779 bp, Homo sapiens
  misc_feature (1)...(779): n = A,T,C or G
cnnntttcaaatcgcttgttactngttctttttgcaggatcccatcgattcgaattcggcacgaggtgaggggctgtctggcccttctgattttttgttaacgagacatggattgtggcatcaagatttagattcattcctctgtttgttggagtcattgaagccagtatatcctggacattttttaaagaggtccccattctgagaaaagacaggagttgaatgtcttattgattcttacctttctgttcgttatagacgaccagaggaaacaaatgcccgacacggattcgactcagtcataagtgtgaaccaaataggccgatctgggttctctcactgactgaagaggaagagaaataagagaggacagtgggcaaaatgtagggtgacaaccaagggttctggtttgcccagaattgccctgggttcaaccctgaagttcccatgttgtggacagccccgtggtcctagacaaacaggtcaccttagcggtaaaagcctttctcaggagtgagagctccaggggagacaaaacgggtttggttttggaacctggaggaagaaggcaaaatgagaagagtncactggcagtgagtcccggaaaggncccgccttgcaacaancgtggcatcttccggacccacttccttgctctttctcccgttagccctgcccttaatgtngggtcccagtgcaaaanccctnttgggggccngggcccgttgccctgcttaattcaattgcaancttggaccaggaaaagcccagcccagctt

SEQ ID NO: 3782 - DNA, 744 bp, Homo sapiens
  misc_feature (1)...(744): n = A,T,C or G
tacaggctacttgttctttttgcaggatcccatcgattcgaattcggcacgagcaggctcatctccaactgacctcatgatccactggcttcggcctcccaaagtgctggagtgcagtggtgtgatcatggctcactgcagccttgacctcctgggctaaagcaatttgccttcctcggcctctcaaagtgctgggattacaggtgtgagccactgcacgtggcctctttttagtttattttttccaaaattattttgaaaagtttcaaggtggaatgtagtgacaccatcacggctcaccgaagacttgacctcctgggctcaggtgatcctcccacctcagcctctcaagtagctgggactacaggtgcacaccaccacacccagctagtttttatggtttttttagagacagggtttcgccacgttgcccaggcaggtagaactcccgtactcaagtgatccgtccgcctcagcctcccaaggtgttgggattacaggtgtgagccactgcacccggcccatttcttcttagatttaacagttaacattttgctacatttgttttatgtccccatatatctggttttcccttaagctatatgaggctacattgngggtacactttacccaatattctggtatcaaccacagtgccataatcataataaaaaaatttaacattggtgcagtaaaaaaaaaaaaaaaaaactcgaggnctttagaactatnntgagtcgntta

SEQ ID NO: 3783 - DNA, 753 bp, Homo sapiens
  misc_feature (1)...(753): n = A,T,C or G
anacagctcttgttctttttgcaggatcccatcgattcgcaacagaataagactccatctcaagaaaaaaaaaaggttaaagttcctgacttaatgaggaaataaaaaaattatatgctgaagttgctaagatctagcttgtgtttgtgaaattgtgaagaaagaaaaagaaattcatagtagttttatggtcacacttctgcaaaaattgcagccacagtgcatgataagtgcatagttaagatggaaaaggcattttttgagtggaagacatgaagagaaatagcttccaatgacagcattcaagttcggtactatacatggtttcaggaatctactagaggtcttggaacatatccctgtggataagaagggactactgtattgccaaccagggaagcttcagtgcttccagagaatttattagggcatcattacataggcacgattgatttgtttggctgcccacatggttgaactcagtcttcaagtcaactgataccaagttgtccaaagttccccaccctaaaccacatggttggtctttctggcatggcccggctttcaccctaagactactgggtgttgcagctgcaacctaaaatctagtaacaaagacatgcttatcaggtctgacatagattaccttccaaaagggaaagatcagacatctctttgggtaangtcaacttttttttactacattgagacaaattctatttcaaggacagagttaaggagggaatgaatttt

SEQ ID NO: 3784 - DNA, 740 bp, Homo sapiens
  misc_feature (1)...(740): n = A,T,C or G
tacagctacttgttctttttgcaggatccctcgattcgaattcggcacgagaccacacctggctcatttatttttattttgtctagagacagtgtctcactatgttacctgggctggtcttgaactcctggcccctaatgatctgtctatctcaatcacccaaagtgttgggattacagatatgagccactgtgcctggcctatttctgactttttttctttttgtatataagaatatatatttcgagacaaattgtggattataaatggatgcttatttatctcgactgcctttcagacctttttcccccagccaaccagtttttttcttctcaaagaagacacaggtgaaactgaaactcatctatttcttctgattgagattgtgtgggtctactccactcagcttttgcagtacatggaaagttgagataaacgcctaaagaaactagtttcagtcatagatttagtaaaaatgttattgcaaatctcttctttgaactcaangtgcttttctcagtttcttaaaccaccacccagagagatctttcatgtcctctttgccctggagatgtacattgggaacaaaaaccttaagtcagttcttcacttttttactgctttggctcttagtaattatctgntcttctattaaacaaggagaagacagattaaatttctaacagtnagggcacaaaaccaatccatttacagaattagtcttactttaccacatagga

SEQ ID NO: 3785 - DNA, 753 bp, Homo sapiens
  misc_feature (1)...(753): n = A,T,C or G
tcnnntgaanacctttacaactacntgttctttttgcaggatcccatcgattcgaattcggcacgaggaaaagaaaaaaaaagaaatttaaaattctgttttagtggagtcatttgaacttaagtctaagtttataacaacactggcttccacagcacaggaggtgagcatgtgttaatatttaagattggcataactccctttaggtgcaagtgttcaggccaaaatgttcctgagcattttgattcctcctcctgctgcccatctataccaagcccagaaactgtctggaatatattttagtttcctgaatgacaccaagaagtagaacagtcttttcaaaaatgtattttaaaaataagctgaatctcaagaatctgatctatagtataatgaaaactgaaaagtgaagtagtcattgggatactctactgtctcacttaattctcacggcttccctgcaaggtgggtaaaattgttcctacagatagtcaaattgagttttacagttagaaaatgattgggctaggatttgagcccaatgtctgtcagattcctgagtttctgctacttctactaaaatatgctgcttcttgtgtgtccngtcttctgtttggggacaagcagatgatatccctaacaaaatcaatttctttattattattctcttttaccttttggttcccagcagtacaagtcccagttttgaagctcaaaagactggtatgagcatagctcatcgacgacatggtg

SEQ ID NO: 3786 - DNA, 791 bp, Homo sapiens
  misc_feature (1)...(791): n = A,T,C or G
tccntnngaanncccttacaagctacttgttctttttgcaggatcccatcgattcgaattcggcacgaggccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtgggaaaatgcacgatttctttcacccagaaagaaaaatggtgtgccaatgaagatgtttgggtaaaaatccccagttttggttgcnttggtatnggcttacttggtcattcccctttcacaaaaaatttgganggggggggcccnttttgggnggatnccaccttggaatcttgaa

SEQ ID NO: 3787 - DNA, 764 bp, Homo sapiens
  misc_feature (1)...(764): n = A,T,C or G
nccntttttanaccctttttnctaccgnnctttttgcaggatcccatcgattcgaattcggcacgagaaaagacttataagccctctgattgatctcctttgttgttgacttcttgatcctctttaattcaggaatcacagttagatttcttagaatccttctttgtgctccaagtatcaaagaccttatggggctccccagccataatggaaaaagtaatttctttaacaggggagacaccagagcaagagcggagatgggggtacgagggggtcctcatttatgcagctggccagagctcctcatccaacccggggcttagtgaggtgacagatgtgatgttggccaatgtagtcttccttttctttctttttttttttctgaggcagagtctcgctctgtcacccaagctggaacgcagtggcgtgatctcagctcgctgcaacctctgtctcctgggttcaagcgattccccagcctcagcctcccagcactttgggaggctgaggtgggtggatcacttgaggtcaggggttcgagaccagcctgccaacatggtgaaactccatctctactaaaaatacaaaaactggccangtgtggtggcgtgtgcctgtaatcccactactcaggangcagaaggcaggaaaaatcactttgaaaatcangaaggcngaggttgcaantgancctgaanatggcaccactgcactgtanccttgggcaacagggcaagaactccatcaaaaaaaaaaaaaaaaat

SEQ ID NO: 3788 - DNA, 757 bp, Homo sapiens
  misc_feature (1)...(757): n = A,T,C or G
gnccnttttatnccatacngctacttgttctttttgcaggatccctcgattcgaattcggcacgagccactgctacagccttagtccaganttttctctttctcttatctaggctgttantatagcctantaaatgttccgggccctccagtctatttgtcattcaatcacttgtttcagaaatattactaggcacttattttatgccatggcacaattctaggtgctgaagacgacacagctgcgaataaaacagacatgggacctgttcttgtggagcttatactttagtgcgtagagaaactaaacagagaggtatgaaagatagtgatgggacataattctactgaaggttgggtgatcaaagaagctttgctgaagagatttgtgttgatgttggtattttctaaaaacagatgaccaatatggttaaatttggttctgagggagaaggtaacatgagatgagctcagataattagacaggggccagatcatttatatgcaaattagattatgagataacagaatggtatatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatggatggggctaagttatacccaaagctcactttacaaaatatttnctcagtcttttgcagaaaaaaccaant

SEQ ID NO: 3789 - DNA, 926 bp, Homo sapiens
  misc_feature (1)...(926): n = A,T,C or G
tncgncncttttnnnantagnnnnnntgncnnntgnaanngntnnatgangtnctnnntnactatnatgtaannnagacntncgcttanatatatcgngcnnnnananncnngtngtatnatnannagngtgnctaattngncanaaacgcctnnactgaggnacttgtanntntttgcangnncccnangannncgaacaaatccatcttgtaatgaacggnggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcancgagtaccangacctgcgtgacctcatggctgatatccagtattgccagcacctagtggatcaagtgtcgccaccgcctgntcatggaattttgacatctggtacaatgagncctttgtcatccctgangacatgcagatngcactgaaagccaggcggcagcatccggncaggcattggtccntgtgaacaggattgtgtctctgggagaagatgacccaggacaanattcagccaanctgcagcagagggtngctttcctggagggcccctgattccatctgctttnanaatgccaaagtnaanatagagcntnaagcataattacttgaaaaccattgatgggccttcagngggccccatagaaaaatnanaacctnnttgnncagttccttnanggaaaaagancagnnactcctaccntacttggtagtgggagctgnttcaaccacnntgnccaaaaactngtancccccttttanttcnattgntgggaccccanncang

SEQ ID NO: 3790 - DNA, 754 bp, Homo sapiens
  misc_feature (1)...(754): n = A,T,C or G
gnnncnttttgaatncanatacaagctacttgttctttttgcaggatcccatcgattcgaattcggcacgagcattagtgtaagtgcaggtaattgcttcattaggacatatgtattgaaggagggagggcaagtctatagcatggtgataaaaacaggcctcaccctctttctctacccacacagggagcatctcagcttgacttcagggatccaggagccaccagccaccctgtaaacagcccagattaatcctgggtttcagtgtcatgggaggaaggaaggatgacctagtaaagagcaacttacttactttctttggggtggtaactcattgctgaactctggatggcactggtgcgttcaaggcaatgtgattgaatcattggggattattactgaattagggagcaaagtattcttatggaagctgtatgctttctgaggctcaccaggccggatggcatgagccctatcctctgtttgagttatttgactggctttttaagggagtctccattttcattctggccatgacagatcaagaggttatattctcccatcagaccttactactttcctgtagagttgaatattattctgattttatgccatgtctgtgaatgtctttgtgtgcaccctacctagttatgcatctcctctttcaaaagcatgttaaaagatccaatagtaaatgattctgcttatatgaagctactaaagtagtcaaattcatagaaagtagaatgggtgg

SEQ ID NO: 3791 - DNA, 750 bp, Homo sapiens
  misc_feature (1)...(750): n = A,T,C or G
gnnccnttttgaatncacatacangctacttgttctttttgcaggatcccatcgattcgaattcggcacgaggttactgatggagagagcagagaagctggtgtttgcagtcccatctgtcagccttgacacccctactcctgtccagccagtgtttctcaaagcgtgctgatgagcaatgcaagatgatttcatgttatagataagaataaaaaaattgttttgtgtttaactcaaattagaaaaaggcaacaattggtatgtgcgacctgtggttttgcagatgatactgcttaggatgttggtacttaagaaaaggtcaacttttcaaaaatactattagtgacatgtggacctagtcctcctgaagaggactacattggggcaccggtaattgtttctatttgcggtactctggctgtgtggctctggccacgccactggaggcagtgtctgagcctgtgacttgagtagtagctctgtgtcatgtctgctgattctccccaaatcctgaagattcatgatgaagtgactgccggcttggtctgaactagattgaaaacaataaggatcccagaacgatagcactttacaatcctataattttggctcaaattgcctgcagttactatcttaaccctgcctgttatgttcattgagcaccaaagtttttcagtcaattcctgagtaattattctctgggattgaattatgaaatagtaaatatttccactatgcaatcaattggtg

SEQ ID NO: 3792 - DNA, 750 bp, Homo sapiens
  misc_feature (1)...(750): n = A,T,C or G
gncnttttgattccatacanctacttgttctttttgcaggatcccatcgattcgaattcggcacgagcaagaattgctgctgctgttttttttttaattttattttttatttttaaagactttcctaccttctcattgagagagagaaagatgcccagagttaaaataggaggtgcttgggtattttgttgaacttcacaagttaaactggcgaatggcgtccatcagctgttattcagtccttgaacagagcagatatgtttgtgcgaggacaaagaagatgcctcaaagacaaagaagaagatgcctcgtcgtcccctgagctcccacacggcatctgcacatcaccagctcagcatttagcacactggattgacactgccatgttaggtgaggtgacggcatgccctagagtgaaggaatctacagcaatatgatagctaaatgccacatgaagttctggattggatcctggattgggaaaaaacatggctctaaagggcagtattgggacaattggtgaaatttaaatgtagtctatgtattangggataatgctgttatcaattatacatttccttctgttataattgtccttggtcacaccaggaaatgtccttattaggagacgcatgcagaagtcttttagggatgaggacttactgcagcttattctcaaatgtttatatataaggtgacaaaaattaagaaattggtcaatcttggtgaaaagtttatgaagagtaaagt

SEQ ID NO: 3793 - DNA, 751 bp, Homo sapiens
  misc_feature (1)...(751): n = A,T,C or G
ngncnntttgaatncctttacangctacttgttctttttgcaggatcccatcgattcgaattcggcacgagcctaggcgtagtcatttctttattagtccttactttatttttcaaagttacgtaataaatgtctatgtttctaagctatctttagatttgtaaaagggctaaaatgttacttttaaacatgtttggtttattcaaatttgtttataaatctctcctttgtacccctggctaccacccctccccactcctctgcctaaaactaagggaaaatcctgtctttgcccatagcttcagaatgttctgcaattttagacttttacttttaactgatcactgttaagcaagggaggaaatttaccacttctctttgtgatgtaatattgcacagtgaccctaagtggaagccttcctgtgtcctggatgtgagctctgcgctgtcagtggttggcttgtaagctctggctccaagtgttctgaggtgcaaggaaccgatcttgtgcagtagaaagagcttttggaagttggcaagtagcaaggctagttctcatacattctatgctctggccacctttttctgtggcaggaaaacaaaacaggcaaatgcacacaaactgggtacatttaactttgcctcctgagccatctnccaagccatttagctttggatggcctcaatttggaacaagggaacaaacaaaatcatgatgataacgatgatgaccccagtcgtccttactaat

SEQ ID NO: 3794 - DNA, 749 bp, Homo sapiens
  misc_feature (1)...(749): n = A,T,C or G
gncnnttganttcnatacagctacttgttctttttgcaggatcccatcgattcgaattcggcacgagattgcttctgttttaatggtaatttgtctaattgtaaaaataccgaagtagtgattccaagttagaaagtagtgatccctaagaacagttggagaaacatatggtttgttctatagctgtaagcggtaattttgaagcaattttgaaagcattctttccctttaagaaaaaaatagtttcttactgaaatgactttttaggatgtcttgaaaaacgtagtgaaattcatctagaaacttacaaggttgatgctagccatcacatgcatgctgcaatttgctgaaatgtcttgatccaggggagctaaacttttacaaaaataggtttgtttagaagtcatatcactacatgaaaaatcaccacttttgaaacttacggttaaaggcagtttctcttttaaaaatgtgctcattgattattcccacccaaatagccagaatattttgtaattacccattaccactcctaccatctgaaacgtgcatgaaaaaaatgaaaaattgacttcatctgaaaagagttgtgtcatgatatatgaaacgttttttgtaacctccaggaaggaacattgcaatttttccatttcagatcgcctttgttttgccattctctacagcagaccaaagagtgcatcaaatgtacattatttcagcatagataatgacttgaatatgagaagtaa

SEQ ID NO: 3795 - DNA, 753 bp, Homo sapiens
  misc_feature (1)...(753): n = A,T,C or G
gnnntttgattcccntacanactacttgttctttttgcaggatcccatcgattcgaaaaaaacaaaaattcccataaaaaaaatagatgtttctnacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggcagggtcctttctccctccttttacacgcgcagacaaagcttgtggatgctcaataaggacagctgccgtttggacagagattaatcatttatttgtgaaggttttttctgccttgctttcttggtcttttttaaatcttcacattggtttgatcccaaaatgtttgtgttgtccttactcaaaactaggaaaaacaaattatgtggtaagaagctcagagccacttacttaaatctcaactagatttatttgtgagaacatctgttttctggatatttanacacttcctctt

SEQ ID NO: 3796 - DNA, 755 bp, Homo sapiens
  misc_feature (1)...(755): n = A,T,C or G
gnncnntttnaatnncnatacaagctacttgttctttttgcaggatcccatcgattcgaattcggcacgagacagcattcgctgaccattctcctcctccacccaccaaggacaggagggctaacccaggcagagaacctacgctgagaactcaccaccagaaaaaatatctgcttttaaaagcacagtgcacaatagtactttttaaaagctaaaagagctaagtttaaagttaaagacacgtatgttctttgacacagatctcctaaaagtctgacaaaattagaagtaccagcacataaaaatagatgcccaagaatgtttattgaaaaaagctgaaaacccatgactatctcaataggacaatgacaggatacacaatggtttatcatgccctgacctgcgagcagtgaccaagaaggagggcacagatcacacagcagacagacagatgctctgaggcttacgatggggttatatcatgatgagcccattggaagttgaaaatgccgtaagtgaaaagtgcatggcaaactgggagctgctgccgctgctgctgcccacatcacaagagaagtacagtttctgaatgtctattgcttttgcaccattgtaaaaagccacaaaatcatataggtcgaaccattaagtcagagaccctctgtgcatagacttggcattggcccatgacaagtgaaaagagtaagctacagaataatattcatccattcttcatttttataaaaccacttttt

SEQ ID NO: 3797 - DNA, 745 bp, Homo sapiens
  misc_feature (1)...(745): n = A,T,C or G
aggnttnntttntgactcatgcttggnntantngttctttttgcaggatcccatcgattcgaattcggcacgaggttacctggggggcntntgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggaccaggagcacacctactngacaagcttaagatctccttggccagcaggacgcccaaggaccagacctgtgtcaacgtnctggaacaagtgtgccggcgtncttcaagcangggaactgacctttcaaggcaaggtgggcttcaattgtcttgaaggtccggatggct

SEQ ID NO: 3798 - DNA, 784 bp, Homo sapiens
  misc_feature (1)...(784): n = A,T,C or G
nggccntttttgaaaacccttttcaaactacntgttctttttgcaggatcccatcgattcggaaatccctctcctgaccacttgtcagaaatcagaaagtgtggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaanagttaangaaacaacttgtactgaccccattaacactantttatttttacattggncttccaaaagggcaggttnaacaaactccntaacttgganttccttggaaaaaaaccnnccntttggcctctgaanatctnnngnngngggctaaattgganaaaagngggtcccaaaattt

SEQ ID NO: 3799 - DNA, 750 bp, Homo sapiens
  misc_feature (1)...(750): n = A,T,C or G
gcnnttnattanatcagctacttgttctttttgcaggatccctcgattcgaattcggcacgaggacaaagcaaaacatcaacattaagtcataggctaggattatacaaatgagaacccccaccttatacattacttaatataagttaactacaaagagcctctccacttacatttttatcatgcatcttacattttaatgtccttattcttttatagaaaaggtcataatacccaataaaaaagaatctgtaatatccctgatgcagcaacaattgatcacatgctttcacatgtgaccacaataggaataaaataacagcgtaaagaaatttgaaagttgtattacatcattattcactgttcaaaaatttttttcaagaaacaagtacactttcaatgaaattacaatgcttcagaaaatctcccttttaaagttatatacaaaaacagctttagttgtggattcatttttatactcaatactctgatttagtgtaatgtctgaagtgtcagtgccttattctagtgtaaattctcatatttacgtaaaatcaattttgaattaaatatttttttcatatttacatctgcaaaaatatactttagtataaactctctgatgttttctaagctatagattttgaaaaaaaaagtctttccaaattcattatatttgcaggactcttctncaatataaattccatgatgtggaataaagctggagcaactgcttcangttttcctctag

SEQ ID NO: 3800 - DNA, 742 bp, Homo sapiens
  misc_feature (1)...(742): n = A,T,C or G
gaaattcatacanctacttgttctttttgcaggatcccatcgattcgaattcggcacgagatctgttactacttcagaaattgctggttgatgttaggcccctcctatctgtgctctctcagctacagtttcccgtttgagcatattcattcttttttatttttgctctgaacaaaaatattagagttacaatattactatattccaggccttgctagaaactggggataaatctatgaatatggtcgcttccctggaagacctcacagtccagggaagccaaaccctgcagacatgcagtagacttagtggtctctcttaaggttgcttgttgagttttgacattggagattatgtacagacttgaatgactagttagcctcaggcacagcattctgtttggcnttggggggggggggnaantactgcctctcagcctgggcaagtcacttagagatcgcctcgtcactctnccatcctttgctgatgcctctggtctantacctctgactcagcttcgcctttagagatactcatgctttctggcaacagaggtccttcaaaccccaattcctattaaaacttccatcacttaccgcccttctttttcaaggggaccaagccagntttattncccccattttnccaggtnacttggtcccttgggcccaanaatgtggtggaaaatttttggggcaaaattccccnttttttcccttnttttttnttgggancttcnann

SEQ ID NO: 3801 - DNA, 785 bp, Homo sapiens
  misc_feature (1)...(785): n = A,T,C or G
gntnaatttcaaagacgctnttgttctnttngatgntcnnancgactctanttcngcacgagtggcagtgggagtcgaagcgagggtctgaagttcacgactactagaaggggaggggagtggaaaggctctcagtgaaaaangtattanaattatttctgaattatcagtctctcatttgtgctttggagaagcanaaaaggcaaaaggggtctttggccatcttctgctggagcttccagggaggatgtgtctccaanagaccagatgtccgagtttgaaatcccagaacccangaggaaaagaatcacagggaggaaaagactgtccaaaggctcctggagtcttctgttctctaaccttggaangttttgaacaatatttctcanangatagccctttttttccaaccttttttttttntcatctgtccagcatgactcatcccccgggagtggttgaatgtcttgtctttcacccaagaaaggacggacttttgcattgggcttgtaaatttggcccactggttgcttaatgggaagtaaaaaaaagagtcnttgcttaccatgccggggaacctanaaattaccatcactggcgtttttttngcttttggttcttcaatggggttggtagggttattgaaattatttantttnccaaanaaataaaaaaatgggatttttaaaaaaaatttttcatcccccggnnnaantttttngnnnnnngnnttggaanngncnnngcncnntattnannctttnnnntttnnnnnccnttttttt

SEQ ID NO: 3802 - DNA, 751 bp, Homo sapiens
  misc_feature (1)...(751): n = A,T,C or G
gttgantttgaanccctcttgttcttttggaaggctcccatcgattcgaattcggcacgagagatgttataaaatgtgtaggcttttaatatataagttatttgggctcctttgttttgggcatacttnaaacagaagaaaaccccttctgggggcagaaaagctagaactggatatcacagttccctctgggtgggctgctatgtgtcaattcgatctccttaaaagaaaatngtggtagcctaaaatagggtctttctttaccacaagttagatccctggcagcaatctacttctcgaaacagaataaccattcaactatgacagctatcttaaaatcatagactgtaaataatattggggcacttctacatatcatagaaaataatgtttcaaccagaaaacatcttacctttttaaagctttccncccccctaaagaaagacatccaatagaagttgccacttctccatttatcaaaagtaaaatctacttccatgtaggnccggcnacttctttttaccttncagtcaattcttaactatttaaagactaaaacaaaataacttatctgnntttccattttactacagtaaatgggtattaaaaatagttcacatggcttttctttttaaattcaaaagggtattaacctgggatggtggaaaaacccacctttanccacacctccttaaaaataccttaaccttaacttncttaaaaccaatttacccagancaactngggggct

SEQ ID NO: 3803 - DNA, 750 bp, Homo sapiens
  misc_feature (1)...(750): n = A,T,C or G
cttaattccatcagctacttgttctttgnaagcattccatcgattcgaatttcggcacgaggccatccttctctctggctgtagactgaggcttttctcttgcttcaagtcagagcagnatttgttgatnacctnncaataatgtttggnnnacatgccantnattaaattaattcaacatgaagttgaatttgatgaaagtggtcatcgtatccangtattnggcttttgaangttttgcangtnaatggagatggaactcnccctgncacacacnctgaactncantggtgcaatctttgnctcactgcaacctccgncactgggctggagcaattcccctgcctcanccttnaantagctggaattacaggcatgtgtcaccanancccgggggttaaaattntttnttttnatttgaggaaaagcngggtcaccatgtaggcatgctggtntcnaacccctgacctnangtgatccacctgncnttggccttcaaggngctgggattacaagcttaaancaccatgtcagccagccaagtattnggnttttnaaaaatttganntttcntttgcgcaaagggaatanaattttcctnctgggtnaaaaagaaaccttttnaaagcccncccttnttttcaaaanaaaaaattttaaanttcnttttgggnggtaaaacctggccttnaaaacccctttnacttgggcaaaataaattttaatttttttnccccctttnantttttn

SEQ ID NO: 3804 - DNA, 711 bp, Homo sapiens
  misc_feature (1)...(711): n = A,T,C or G
ttnatttcganacnnctcttgttctttttgcaggcatcccatcgattcgcccagctacatgggaggctgaggcaggagnaatcacttgaacctgngaggtggaggttgcagtgagccaagattgcgccatgcctgcagcctggcacggccagngnctccttgtcaaaaaaaaaaaattaatnaatgcctttggctaaacgtaaaagcntttnttggaccancttaatgcttaaaatctgttttngttccaggtgggttgttaacagggactcatttttttggtcttggatanggatcccggctactcaaacagaaaatggaaggaggaatctggttaaagaaaacaccagtntccagaatggtgaagntttggnaagaaaactcctttcttgctcaaagaaaaatttaaaaggttnggnccttttcccaaaaaancccnacacttttttttttcttgantgaangggctttaaaatttcttnggaaatagttttaccaaaaatgggatttaaaaaaatcctaccgatcaagatgagttcagctagnaagtcntnccncctcaggatcagcttaagtattttacttgatttttttaccaaatcaatgcncgtacctaccttaatccttnaaataagtttanaatttacctaaccccaaagtccaggagggtgttnttaccaaaaaatagctttntcaagggctggcncctaa

SEQ ID NO: 3805 - DNA, 668 bp, Homo sapiens
  misc_feature (1)...(668): n = A,T,C or G
tganttcaatccgctcttgttctttttgcaggatcccatcgattcgaattcggcacgagggtggtcatccctaccttgttcctaatcttagggagaaagaatttgtctttcaatgagtaagtctgatgttacctntgggattttttggtnnatgctctttatgtgtttgaggaaaatcctgtctactctagtttttaggaaggangnccctngaatcggtgttgnatactntggcgatatcanaatngctatggnnggngncnngnttatncncattaagctcggaaatangtggtggtgcgacatcacaatgaccnatacantactgnangggccctagcnnccaatccttanggttccnnncatttnttctggctcngaatcaactgcatggncantnngccccccnannngaantanggaaggannntcacataggtacatgtgactatccttactnaatctggctntaaaaacatggtcctnnacatnaacatnttanancatactttgcagatntttgcggnctgcnctgaaatgtcccataaacaacntnnttacttnanggaaaaaanatactccatgggggnnaaanaaccatggaggaangaaggnaaagggccccncatgccnctgcangtttancaagggcagnttatttattctta

SEQ ID NO: 3806 - DNA, 707 bp, Homo sapiens
  misc_feature (1)...(707): n = A,T,C or G
tgatttccatnnngntacntgtctttntgcaggatcccatcgattcgaattcggcacgaggactagaaagaggccctgccctctagaaagctcagatcttggcttctgttactcatactcgggtgggctccttatcagatgcctaaaacntnttgcctaaagctcgatgggttctggaggacagtgtgggcttgncacaggcctacagtctgagggaggggagtgggagtctcatcaanctnttnggtcttggcnttatggcnaccactgctcacccttcaacatgcctggtttacgcacnatcttgntcatgggaagaggtnggtggnagactctcanagctcaagatgctnagagagaaagntccctgaactgggcccatctgactttctacctaccccattggtttttttggcnccttttntcccactcaatancttctggcagnatnctcctgagccacatgtgccangtactggaaaaacctncatctttggcntcccaagagctntanggactcttcatcagcactagatttgcctcntctaagtntctatganctcgcaccatatttnataaattgggaatggggtttggggtatttatgcnnncctataaaaactatactgagtcgtntttcgnananncaanacnttataagnatncatttgatnnantttggncccccccccttcttanaattnggn

SEQ ID NO: 3807 - DNA, 698 bp, Homo sapiens
  misc_feature (1)...(698): n = A,T,C or G
ttanttccatacagctcttgtctttgtgcangatcccatcgattcgaattcggcacgaggtttgtataaaggttgtcagtttaatattcaagcaattaataaagacaaggtgtgagtttttctgttaatgcacctctgtctttaatgtggaancaccgtataaccatgcatcttaccataattggggtgcatgtctgtggtacatgggcacaaacatttttctttcagccttgtaatcacatctccaagtaatctaagcaaaaaagaagcaaaatctaagccagtggacatgctganggctatcttaagggcttctggaatgacaaaggccagaaatccatcttcatatcattttttttttttttggaatcnaggtcttgctattgttgcccaagcttaaaaaaattggcccgggggggnngcttttcnaggngcnanatagttaatgnatcctttaacctcctggggttaaanganccccctgcctcaanccttttggggaacttgggacccaaggngcnccnccccacctgggaantttaaaagcatttttatataaaaaggggaaggtgggctgtngncttttcctntttacctttnaaacccgggaatcaaaaaanaaggggcaagnggggatttcgggccatacaagccngggtttggggtccctggggggaacattttttttttttttttta

SEQ ID NO: 3808 - DNA, 639 bp, Homo sapiens
  misc_feature (1)...(639): n = A,T,C or G
ttccatcngctcttgttttttgcaggatccctcgattcgaattcggcacgagacactgggctcaggggctgagccattgttgggtgctattacttgtgttgggaaccaatanggaacagaaaacaancaaaacactaaccagagaancgggcttattgaatnctttgcacctaagaagattaagaggaaaaggaggaggttagagttggtgccntctgctcctccggtgtctgagtgttgataagaaagatagatgttaganggtagcagaattgtgttgcaagaattaaagccaccagcagatgagacttggaccctaaccaattccccaggagaacctgtgaaaaattaatgtcttgaagtaatggacatcaaaaggagcacttattttttggaatttggnaaaangctctagatccttaggaggatctattttgctcatttgnnggtgagaaactanattcaaagagataagtacttgctcatcattagtatggcagagccaaatcaactagatgtaacntgtcttaaacaccgactgtaatgnaatctataactntactggagatctncaataacagcctcagtgaccttgaaacccncagtngttagtaaatatcctggttttcctgatttagc

SEQ ID NO: 3809 - DNA, 727 bp, Homo sapiens
  misc_feature (1)...(727): n = A,T,C or G
nntttgaantccaatanatatatngctanttgtgcttnatgccntangattcgaattcggcacgagcctacctcaccaggttgtcgtggggagtgaacaaggtgagtggccctcacctacagactcaacatatggcctttggctcttcccacttccaagagtcttggaagggatgggtcgagcaagcagaggaaaggaagatgtgagttcccaaaatgctcctcacctttttcttctgagtgggctccttctcactgcattggagggcttgcggcgcancatggtcctccaccctgggagactccgtccctgctctcttaggtgtcaagatcagaggcctcttgcttacctaccagactgcccgggggcacggcatgaaccgagccttcagcttgccaacnttcnttgggaaccnttttggnntgaattgcaanttgggggtgcnggccatggacaccccggcagcaaccagcatacaagaagcccttgncacgtgacctactcttacagcaatcgcagccctgccggccctanggaggaaggaagtccaacttcagtctcagagattctgatgcagtatatcaattgngggttggctgtggccaagaatttttaataacttttnaaataacctttctttgggtatttaccaaaaagccnaacttggtantttggtcaatacaaatttttcaccaaaaccccctttaaanccaaaaaaaaaaatttt

SEQ ID NO: 3810 - DNA, 728 bp, Homo sapiens
  misc_feature (1)...(728): n = A,T,C or G
nttcnntttgaanccttacanctcttgttcttttgcaggatcccatcgattcgaattcggcacgaggtcgtcggttttctgagggtacttcagctgacagagagattcagagaacgttaatggaggtaatatttggtaaagggggtttataaagaaaccaatgtttattaaatgaagaactgaacattgcatatttgatagtcaaaatatatagaacattttaaatgaaatatgaaatttgaaaatattgtcaggaacaaacatgtttctctatcacaaactctaagaaaatgactactggaaaataaggctatctgccaaattccatttggtatacacctgtactattctgtgttttttgagtagatcagtcattcatatatttaaattcttatgaatgtggaatccttttgggccgnngcgagttatgaagacatttttgnnatggcatattaagactgttggcaataaatgagcttaattatgtatgaagctgctctaaaaattattttttctctcactttattgctgagactgaggcaactnaaatagntttgataattggaagangatnnatgacagaatgaaaagaatgccttaaaggncctttccttccnagtttttaccctttcccccacttcccaaaaattcttntggaaaaggtggaatnttcaaaaaattnccaaantaccattttttcccacctttcaaaattgggaaaacntagg

SEQ ID NO: 3811 - DNA, 931 bp, Homo sapiens
  misc_feature (1)...(931): n = A,T,C or G
gnntnannacngaaactnttnaactcctgttctttttgcaggatcccatcgattcgaattcggcacgaggtggctgttaagaaaacantggttttttcttttaaggtgatcatttcatgttcctatggtatggatgcatgtagaccttttangaaacagttaatgaagtttaatctgcttatgtggaaggaaaaggtttgaatggaaaaggcttcttggcatgcaacggaanccgccctgcttttcccccgatgtgtctatttaggaacatttctgtgacacttgccttggcgtctgcaacctgctacgtngctccttgatgganggaanaagcctggccgtggtanagggaaagctgagctctgttgggaaaatgagagttcctattggagaaatgcctctgggcaacntgnctggcctttnccnnaaangtttgggggccgacataggctgtgtacaagccanagtcnaaggtattaaaacctaaccagccantgcagaagtcagnttgggaggttccnggaaagtgcctaaactaaggcccnaaaaggaccaaangggcccggcncccccaggggtanttaaaaaaattaaaaaaaatccancccctccaaaggncccttaattnttncaantttttcccctgggccccttaattccccaattcctttngggncctttngggggaagagcccnttnaaaattttngggcccancccccctttttgggccntttnaaaaaaaaggngtgggnaaangggggntttttttttttttgggncctttccaaattgggggnaaaaaaagggcccttgggccccctttaaaaagggggggcccttggggtnaancctttccaaccntttaatttcccccccaanttttaaattttttgncccctttaattttnaaaaatnccttnccccccatn

SEQ ID NO: 3812 - DNA, 798 bp, Homo sapiens
  misc_feature (1)...(798): n = A,T,C or G
gggccntncgtnaaccctttgaaactacccgnnctttttgcaggatcccatcgattcgaattcggcacgagnaaagaactcaaagggcagcaatncntttaagtaaggaaaccagttaggagataattgtggtaatccagggaaagaaagatggcagtttatactggggcattgccagtgtggatagaaatagatctcagaagaattttaggaagtagaagtggcaaaacttggtgactgaattgtgagggcagaagtgggagaaatcaaggatagagtttcttaaacaagctttggtgaagacagggactaccctatttgctgtcatgtatccacagcttagcacaaatctttatacgctggagatgcttgataagtaccgagtgaaattttctggcttgagtacccanataaatgggatgccagtctctgatttaggtaacacagaggcagactcacttgggaggtaactggtgattcanttttaaacatgtctagctcaacatgcctgtgaaacatacacatgacaatgtccagatacattggcaattnggatgaattgatttctgnaactcaanaaagagaggtctgagatgggattctttgcataccttaccaaaaaaaaaaaggtttntgtttntttngnaantnaacncgnttttntggccntgttaatcccantnnctttnggggaggccnangnncgggggngtnnnccnaagggntcnggnntttaananccntccccancccaaaatagggngnaaaaccctttttttttttaaaaaaaaaccttcn

SEQ ID NO: 3813 - DNA, 465 bp, Homo sapiens
  misc_feature (1)...(465): n = A,T,C or G
atganncttttacaanctacttgttctttttgcaggatcccatcgattcgaattcggcacgaggagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaaccgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaag

SEQ ID NO: 3814 - DNA, 516 bp, Homo sapiens
  misc_feature (1)...(516): n = A,T,C or G
ttcatttannctntttttttgcaggatccctcgattcggaagagcttctgcaggggctgagcagaccccagggcctcttagccaatccccgggcctggtgaagcaggcgaancatatggtcggaggccngcaactacctgnacttgccgncaagagtgggcaatcttttntgtctctcgggaangncccaannctcctcccccaanttgananaaaaagnaagttntggtnaacccancntaagccataagttcccctggggcccctgggganaaagncttcaatcacngggccaagggcttctggnccccattnattgncttggacaagaactctgggtcacaagtcttgctnggtcttgctggggaancccnaccngacattgggccncagacttgctggtcttnttgggaagaagggcaagaccccaaaccaagatccaaaatacacttncagctcttaaccaaggcttnctttcaagtcacaagttgttgccngaaatcagtaacaagaagt

SEQ ID NO: 3815 - DNA, 461 bp, Homo sapiens
  misc_feature (1)...(461): n = A,T,C or G
attcattncacnnctggttctttntgcnagatccctcgattcgaattcggcncgagagctgggggtgactacagctcacctgcagctggtgagcaacttcaangcgtgagacccaggtgggccgggcctggacccctgtgccatggcaacnntgatattncagangtntgnnntangcncatnactgtnnnnggtnnttntctaggnngccttaanttancacatcnnnntncttcgntagnnnaaatgncctcntatnagcatnccttccttcnctgantgntnnatgagagcatgatntataatgcctgaaagancctgggtnngngattatnnntnagttaataaatnattctnancactatcacatgntgantgccctnctnacncncctngngnaaagagaanactgacaannnggnntanttntantncctngccaanancnnngttaccagcct

SEQ ID NO: 3816 - DNA, 466 bp, Homo sapiens
  misc_feature (1)...(466): n = A,T,C or G
tntacgttcaagctcttgctctttttgcaggatcccatcgattcgatgcgcttattaggtattttatctttcaaaaatatatgtncccaactgtgtttgtttgtttcctgactgtgaacactgaagaggactagatcaaaaatgaccaattgagtagcaattgaacatttacagtgctgtgtgcagtgaacttctgtagcacccaaattgtggggttggggaaaaaccattccaccttaaaagaaaaccaagcctttctggcaaaattgctgattctaggttttggccaagaaatgtacatgctgactggaacattgcataacagttagtaaggaggctgttaaagactatttagggtcatttcagaaagactggagaaatgactgtagaattcccactggcccagagatcnggtagaaacctgtgaagtgtgtttaaattcttgagttcataatgggtattttaa

SEQ ID NO: 3817 - DNA, 459 bp, Homo sapiens
  misc_feature (1)...(459): n = A,T,C or G
tgccntncagctcttgttctttttgcaggatcccatccgattcgaattcggcacgaggagaaactgcattttgggggggtttgaaatccaaagaatgcagtttgtaggcagtcgagatccttgaaaaatcaagatggattttaataatgtattaagaataaattggatttgaatcaacacaggaaacagggattttacttagagactatttcagtaattttgaaatcattgcccaagattgtagttggtttgtttataatgggtaggttatttatttgtgaatcccaaatgtnctccatcaacattccattgaataatttacaaaagcaaacagcaggggtttatgtttctcttctcctagttnaatattgtggcagcatatcatactttgttttagactaatttaacaggagttaatgtttccaagtaaatcattattatctaaacagtgtctttttn

SEQ ID NO: 3818 - DNA, 465 bp, Homo sapiens
  misc_feature (1)...(465): n = A,T,C or G
nnntnnctantcaagctacttgttcgcaggatcccatcgattcgtnttcatncanggggtanatgaaaaggcngaatggattttattnngagccgtgngacgtgccgtcagaggctntctgtncttcctcctcacttcagcgcnnantgccacncccaanaaacgggattctaccngnctgnnngcncgtccgnnctgctacctcnngtgcccatgcatcgnntntcacnccaagaaagaggctnccttnctcnnntncttcattngtacatagacnaatcccaaaaaaannatgaacntnagcgcaagagncnttgactcccagggagatancgacngtagctcttcttcctcaaaataatgcatgatgatgcngcatacacnttataaccaaantatgctngccttntaagcnnacgnctgtccntccnacactatnagaggcngaagcnnacntgatctcct

SEQ ID NO: 3819 - DNA, 469 bp, Homo sapiens
  misc_feature (1)...(469): n = A,T,C or G
tannatccttancnnnnnnctacttgttctttttgcaggatcccatcgattcggcctaaaattagagaattatctgctcagtccttattcctgcagaatacaaatgtcacattctaacctgttaagagattgtcttcaaaataaaactgttattaactacattaatgttagacaaagtacactttagggcaaaaggcattattagggatagatttcataatgatagagttctatagtagaatatagtaatgcaactgaacaaaatgaagctcattccactgcatggaagaatctcacagatgtgatgctgaacaaaggaagccacgtacaaacacttactatataattttatgtacatcaagttcagaaacaggatagttacctttgggaaggaggtaactgaaagagtatgaggaggggtttctggtatctggttaatgtactttgtaccagttacccaggagtgttt

SEQ ID NO: 3820 - DNA, 462 bp, Homo sapiens
  misc_feature (1)...(462): n = A,T,C or G
gatnccaatcanctacttgttctttttgcaggatcccatcgattcgaattcggcacgagacaaggacaagaaagaaagtacggttgcaacggctggctcgcatgcatgccgacatgatggaggatgttgangangtatatgccggngacatntgtgcattgtttggcattgactgtgctagtggagacacattcacagacaaagccnacagcngcctttctatggagtcaattnatgtncctgatcctgtcatttcaatancaatgaagccttctnacaanaacganctggaaaacttttcanaangnatngnccggtttaccagagaagatnccncatttnaagtatactttgacactganaacnnngagacagntctntctggnatgggagaattncacctgcaaatctatgctcanangctggaaagatgagntntggctgncttgtntcacaggaaag

SEQ ID NO: 3821 - DNA, 464 bp, Homo sapiens
  misc_feature (1)...(464): n = A,T,C or G
cttnnttagatacagctacttgttctttttgcaggatcccatcgattcgaattcggcacgaggattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaattaaacatcctgtataacctattttattctctgccaaacaattttatgactgctgtttttactctttgtgatgaaaatgggatggagaagataaggttctttg

SEQ ID NO: 3822 - DNA, 463 bp, Homo sapiens
  misc_feature (1)...(463): n = A,T,C or G
attncaatacaagctacttgttctttttgcaggatcccatccgattcgaattcggcacgaggcantagctgtggggatggagaaaagtggacaaattaattagagagatttagaggcagattggtgattgaattgagcagggcagtgagaggattcccaggtttctgactgaggtgtctaagtggggatggtgatgaaagggggaatattgggagaggatcacgtttggagggagactaaggcaccatcagtattctagagattagagggctgtgagagaattgtgatangagggatttactctttggcagatatccaagcgtggaaggcctgtttgatggactgtccttgataatcacaggcaggtatancctcaaggctttgaggatggctctaaagtacatttcaaacaccacctcctccacaaagcctttctactacaactccatcccctgagtagagt

SEQ ID NO: 3823 - DNA, 470 bp, Homo sapiens
  misc_feature (1)...(470): n = A,T,C or G
anaatacctttacaagctacttgttctttttgcaggatcccatcgattcgnananataanaangnnaaaatncagcaatggtncacaggctnncncctaannnatctgcctgctgncatcagagccnatgtnctgggcntnntntctggggntacattatttaggccantntatcanggccaacccctccanctgnctantagangccatgnccactngntaattcaagggcccagctccaggnnngtttncttctctnggggancatcagttnncttntnnntaccacgncattcccattngcatgttntngccgctnntcttaatagataatatnnaaaccctnattnctcncgctnactaantaccatcattnatnnagtaaaanatctnanaaaagnngncaancnagnngntnntgatnctnctcctcccctcccccacctgtgtttttaanagacaggattccn

SEQ ID NO: 3824 - DNA, 465 bp, Homo sapiens
  misc_feature (1)...(465): n = A,T,C or G
ttanttcnatacaagctacttgttctttttgcaggatcccatcgattcgaattcggcacgagaattcataaaaggagttagttgcagtcatgtgtggccttgtctagaagcaaaaattataatatcaaaagctctacgtatgaattgggccttaatgtctttgtactcatttattcttttattgaaaaaaagctctaaatgcctattttgtgtcacataattgagatttgctttgaaatgtctgattctttactatagtactatctgagttgttcacagtggtatggtgatccatactctgaactgttccattatctggaattaaaggcatataataaaaagaaatagactgtatttagtttattctagtgtaataaattgaaaagtaaatagatgattagaagcaagtgttccaaataaaaatttatcagcagtataacaattctatcattcattccaacttgg

SEQ ID NO: 3825 - DNA, 460 bp, Homo sapiens
  misc_feature (1)...(460): n = A,T,C or G
cnttgnttcgatacagctacttgttctttttgcaggatccctcgattcgaattcggcacgaggagagtctcactctgttgctcaggttggagtgcaggcatgtgatcatagctcaccgaagcctcaacctcctgagctcaagtgatcctcttgccttacctcccaagtagctangaccacaggtgggcatgaccacacctggctaagcttaaaatttttctgtatangtggtgtctcactatgttggccanactggtctcagatgcctgggctcatagcngtcctcctgcctcaaccttccaaaggctgttgattgtttaaatacgaaaaantttagaanatatantttnacgcacttaattnttagtctggtgatataccatccaaaangcntctnatgctgggcacngttgantcatgcctattatnccagcacttngngaggccnangcnggangat

SEQ ID NO: 3826 - DNA, 751 bp, Homo sapiens
  misc_feature (1)...(751): n = A,T,C or G
nncnntttgattcnatacanctacttgttctttttgcaggatccctcgattcgaattcggcacgaggctcaatcaatatttattgagtgcctacgacatatcaggctcagttaggagctggggataaagcagtgaccaaagcagacacagttccttctccagtgagattataatccagatgggataggctataaataaaggaagaagttaacatatatcaggtggtggttagtgctgctgagaaaaatgaaggaggggagagagaaaaggggatgccacaaggctagggtagagagttctgtttcatacagtggtaaaggaaggcctttgtgttgagtgctttgctctggaacgactttaggatggggaagaggcccaggtggcacctagacatttgaaagtaagggctgaggctgcatgtctctacctatattttctttcatgtttgcctttcatggattttttttctatgtatctagaattaaatatagaactagggtgaaatatccctcaaaaatggtatgggagcaactattagaatgaataggactcttggggccaatgggatggaatgtctgtttctggtcaagaggattgattttgatactggaatagaatattcacatatatcttcccattgcctgactncaatgggtgcctagctttccatcaaagtgggacttggtgaggtggggatgtggatgcatattaattaaggtacagctggcaccggcttaaatagaagggaagg

SEQ ID NO: 3827 - DNA, 463 bp, Homo sapiens
  misc_feature (1)...(463): n = A,T,C or G
tnncnttcanacangctacttgttctttttgcaggatcccatcgattcgaattcggcacgagaaacgaccacctttacgagaattctttgtcgatgactttgaagaattattagaaggtgagagaactctttaccacacgtttcttccagatgctcctatggtcccgtaaacaatgatatttttttctgcaaggctattttactttttaagagcagtaatcgtggcatttgccgcatgatgggaacccangtagggagcgggtgatgttcccaggcagccttggtgtcggcaggtctctaaacctggttgttagtcgtcctctgtgggagttgattttgttctgtgacccaggtcaggtctctctctaagaactctgtaagagtatagaaatacaagtaaagtataaacatgtagaaaaacaagtaaactggggaaatccttcgctggcagcaaaactggcgt

SEQ ID NO: 3828 - DNA, 747 bp, Homo sapiens
  misc_feature (1)...(747): n = A,T,C or G
gcnnttgnttnnatacanctacttgttctttttgcaggatcccatcgattcgaattcggcacgaggagttctcttgtgttttactctttttacagtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaagctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagcatgtgaatggatatacaaataaaagatgaaacgtaattcatatagaagtactgacaaaaaaaaacactgtcattacagtgtctattgcctgtaaacctacaagcctgagctggtcttctgtaacttttgattaatgttatgttattattgggtaagttaaaatctcttggcttn

SEQ ID NO: 3829 - DNA, 468 bp, Homo sapiens
  misc_feature (1)...(468): n = A,T,C or G
tttcctttttgtaaaccctacttgttctttttgcaggatcccatcgattcgaattcggcacgaggtaaaacaccccctacagttccaattctgggcctgtcttctatctatctttgcccttctggtccgttccctgttctgagccccagggaacttanggctgaaagtcacccccgaagcctcagaccagatcgggaggccacacgcagctcatggggacagagggcccagggtgacggtccactcatgagaagtgctatgtgactncagggagtctgtccctcttccgggctccaatccccagcccaagctcagatgacccagcctgtgtccctttagcggccgangagccaccacctgttcgggggctggaggatggcttccagangacctgggacactcacctagctcgttcatggcacggcggtactcctcatcaaaggacaagcttcataacagcacangtgg

SEQ ID NO: 3830 - DNA, 467 bp, Homo sapiens
  misc_feature (1)...(467): n = A,T,C or G
cnttgatncntatacanctactcnanctcttgttctttttgcaggatcccatcgattcgaattcggcacgagggggtctcttctactgtcttattggaccctagcagtggctctgagccagcagtcctgtcagttgatttcttggtcgttcctttgttttcttctataatcacatgtggactcagaatgaattttgagttactctgaaatctatttattcaacagatatttacttagtacctcctattgccagactctgctttatgttggatattattttttaaaagcccaccttgcctagatttcctcaaaggaccaggtggcttccctggttttgaaagaccctaattcttactatgatcttaagtaaattatatcctttctgtgggctcaagttctttctaagagggctctttggggctacaaaagaaattgttagtgcaaaaagagtttataaggtttataaa

SEQ ID NO: 3831 - DNA, 471 bp, Homo sapiens
  misc_feature (1)...(471): n = A,T,C or G
tntttnantactnnaantcnnatacangctacttgttctttttgcaggatcccatcgattcgaattcggcacgagccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagagg

SEQ ID NO: 3832 - DNA, 470 bp, Homo sapiens
  misc_feature (1)...(470): n = A,T,C or G
tataccattttgaattcnnatacaagctacttgttctttttgcaggatcccatcgattcgctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgctcctcatttcaatctcctgtacaattgctcctgaacagtagtacagaattgtagagatagcacattatgcaacctggctttttatctgagacatacttaatgaaagcaca

SEQ ID NO: 3833 - DNA, 465 bp, Homo sapiens
  misc_feature (1)...(465): n = A,T,C or G
ntccnttggattcgatacanctacttgttctttttgcaggatcccatcgattcgaattcggcacgagcccctgtgccccttccccaggaaatcaagtcctaaggaataagagtttgttggacagagttgagccttggagggacacaaaacattgtaatatctaagatttttttcatactctcccagaaagaaccaattttcaccctggggtggcggggtggtaaaattgcccctgttcagaatacatgctctaataagcggcagccatgggattttatcctaatactgagtctagatgccaaatctttttcaccctgtctcaaaacaaacaacaacaacagcaaaaagatcactttggctgtttttatttttggctgttatgtgaagaatgaattgcaatggggcaagagtagaagcaccaggagaaaagcaaatgagttttgaataaatattttcccctatctt

SEQ ID NO: 3834 - DNA, 469 bp, Homo sapiens
  misc_feature (1)...(469): n = A,T,C or G
tgccttttgantacngntacaagctacttgttctttttgcaggatcccatcgattcgaattcggcacgagaaagcatgtgtgttggggggtgcgtatcattttaccatgtgataagcacttttcataggtagcaaagacacattatgtaaacttaggaggagggagagaatgcaaatttgcatgtgaattttattttgattaatcgctttttttgcttttcagcaatgttatttatgaacaacaaaattatagaaaaagtgagaaaaagtcaattatcaattattttctgatgaacaacaacaaagacaaaaaaatggtgggattgatttattttcccctgacagaattgattgtttctttaggttctatgcaacttgcagactcactgagggtgaatggaatgtgctgaaaattcagcctgacttggcagctccaagggacacacctcaatgtagagaaagcaggaat

SEQ ID NO: 3835 - DNA, 465 bp, Homo sapiens
  misc_feature (1)...(465): n = A,T,C or G
cnncatntggntcccgttccaagccacgagcccattttgcaggatcccatcgattcnaattcggcacgaggcacaggccacggagagagagaggccgggcctggatgaagccgtgggcgttggtgccgtgcgaggcccancatgcttggaggaaaggtcaccgtggctgtcaagtgctanccagggcnngagccgggcttgtgtttctcgctcantntnanccatctntnatctgnttcaaagggnattcaaaannccngggtcagattgtttcttggattacnctgatcgtctggcctgccttatccaccctggaaagttctaagcagataatanntatgtggcatntctgaggttttgatgccccgagccgtttacaatatgcttccngactgaaagctgggccctgantnnctnngctgagnnctacnttggaaaccacgttcccctcagnctcattatcac

SEQ ID NO: 3836 - DNA, 1039 bp, Homo sapiens
  misc_feature (1)...(1039): n = A,T,C or G
ccagccanaanacngnganaaaaggncngacgnanacagannncgannncgacgccngnngaanaagcananancacccccccaggcgttggaacccttcanagncgacgaaggcagacccacgancgaaccggcacgagactgannagancnggcncgaaaaagtgtgngccatactgagacccacgggcagccncnccgccnctacagngncaggnggaccagggacaccncnggacngcgcannacngagaannaaggaancnanggccggcacgaagggcaagggagggannnctgcacgggacggcanaacngcaagccagcctncaagcnggcaaganccagccaggnggcggcaaaaacaagaaacagcccgaggcncagcccggcncncaaccaggcccnaancaagaaaaganaagcaccngngcnggacggcngnacccacacaacgggcacgnaaaaagggcngcccgcgnggacacngcnnnncatnggaaaccaccnccnggnaaaaancaccanaagggggccngcanaaaacccgaacngggancaagngccanncagnncgggnaaanaggangnaaaaacnggccagnnngcnaccgnggaaaaaaaaaacgncnccnnnatngncgcnncnncnnncacggcaananaccanagcgggacagacanngancgcanacanangcgancggagaananggaaagaagggagacaaaacagcanganngacgaananggnacacgcnacacgcacagcgangnngnancaaaagnanncncngcannannagngngnangcaaaanaacgcgangagannaganagnggacgcacnngcncacnaganggcgnncngacgnnnccccaaaacgacnnacgnnnnggagcaganaacgacgcacnanaaaggacgnanganncannnccgngaanaaaggnagaaanngnngnacnanggcgacnccaggagacaacanangnnaaagcnaagccccnagnacaaaagcaccaaaanaancnccg

SEQ ID NO: 3837 - DNA, 759 bp, Homo sapiens
  misc_feature (1)...(759): n = A,T,C or G
gcnntttgatntncatacanctacttgttctttttgcaggatcccatcgattcgaattcggcacgagctgccttccaacaaaatcgtcaagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggtggggagataggcaagtcggcaatgtagaccagtgcagtgggttggggggtggccacagaagggagtcacagcctgaaacagccctccacagccctagaggccggctttatgattcccactttacagatggggaaactgaggctcaccgtgcttaagtaacttgtccaaattcattaaactcctagttattgagtctctagtccatgtcanccatggtgaagaacgggggagttaaacctacatgtgttctctccaagggccccgatcaaggaaagcttttgtagaaanangtcacacccgagcccacctgatttaattattttgattaatcttgaaaaaaaaatgaacctggagattaccagggaaccgggggccaataangaagtgtagct

SEQ ID NO: 3838 - DNA, 751 bp, Homo sapiens
  misc_feature (1)...(751): n = A,T,C or G
gncnntttgattccatacanctacttgttctttttgcaggatcccatcgattcgaattcggcacgaggcacgcagcacccactcagcacctcttagaagatgcgtccgtagtatatagtatgatttttcgaaggggattttgctcatattaagggttgctttagggatgtccaggaagggtcaggtaaggaatctttcaatctgctttctaattggcttagttttcccactgtcttcgcaaaaggacaggaatttccaggttagtttgcagcttgtctttcatcaagcgaaatgctcatgctgttgggtagatggtaatagaaaccttttgctacctttatttatcaagagttgtggagccgaggaaccgtgtcttgggagttgtgcaggattgaaactcacaaaaaagcctgtttgaagaagttgttacctatatttattcaaggcagttcacaagccttatactaactttgcggggtctttcagttgagcttacatgactgcgcttggctttgtgccttggcagccaacatttgccatgcaggaggcttcccagaaaggttcggattcctcttcaagtttgagaagcctgactgagaccattctcagcatggcatgacccgtgaatcaggaagtgagaatctggagtactgctaaggcaccttgtgggtggaaatgagggtttgagatgccaacccttctgtgccttcccacaacttccaattgtttccattgctcatttgaccaacct

SEQ ID NO: 3839 - DNA, 750 bp, Homo sapiens
  misc_feature (1)...(750): n = A,T,C or G
nccnnntgaatncccntacanactacttgttctttttgcagggatcccatcgattcgaattcggcacgagatgaatttgtctctgaggatattcaaagaaagcagcagtagtagtgttaaagggtcccagctaggccttttcagttctttcctatcattgttaatgtagacaaccatttcccagatttttgagataaatcaatttatttatttgcaatatttacatgcctacatggttttttaaagttattttaatgtatttttaatgattaaaaaattatgtcccgtatttattagtcattcattacttaccattatttgcatttaatccttaaagcagaagtgtacaaaaaagagattaatgtaaagcaaatcaatgaggattgaagcaaattaattctctcaaaataaatatgtagtatctttagataatttggcacctgctgagtttgtcaatcttagcaaactaggccatttagaggaaataattctgtctactttttgagtgtgttttttaatgcttttacttctggtgtgggcatgctggattttatatttctaaaaaccaataaaatttggaaggcattgcctctaaatgttacctaaaaaatagaaaacacaacccntaaatatgcctagtaattagcacatattttatttcatagaaactgattcctggctggcctggtggctcacacctggtaatcccaacactttgggangttgaagcagggggatgcttgacccttg

SEQ ID NO: 3840 - DNA, 751 bp, Homo sapiens
  misc_feature (1)...(751): n = A,T,C or G
nccntttgatnccntacanctacttgttctttttgcaggatcccatcgattcgaattcggcacgagattagatactatagtaggttaataatgactaacaccttgtcatctcatcactgagcttttgtctaagatagtctctgaatttagaactgggacgaaagtgtacataataggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggatacatgaagtattacaagattttcttggaaaaattggcatttcagtgatggatcaaagatgtctaatgaggcaaaatctactattacttaaatatttaatgttttaaagatttgaggataaaaggatatagatctgatggcgttcatactaattgctgtagtgttgatgttggagagaggggtaatgtatcaagacagagcagacagaccctttacaatgagagcagaagatatgttgtttactgattctactttcccacaaaatgctaatgcttttataagtccctcctccntattttctagattaactccntgtttcttcctctaaaccagangattatggcagacaggcaaaaaaaaaaaaaaaaaactcgagcctttanaactat

SEQ ID NO: 3841 - DNA, 800 bp, Homo sapiens
  misc_feature (1)...(800): n = A,T,C or G
aaatacacaacaggcaagtgccgtataccaggaattgttcaaggagagcaggtagtttgtcttatattctaacgtgggagaaagaaagcaaataaattacatgaattgattaattgatcagttgcatggcttttagtatacatttctgtcagtctgccaaccagcacaggtcccttattagcatgggagaagggcctgatcactgaaagtattatagatttatagagtattgaaaggaaacttaaggaaattgggggcagtggccttttagaaaacagcctaactccatcagtgacttctgcttgcttgtgcctctcatatgtgatctgctactggcctttgttacttctctctgaaataacacaaaaattatgtttagggctctcattgacttcaactccaaaccatatgttacttcttttaaaaacataatttctaaaaaaaaaaaaaaaaaactcgagcctctagaactatagtgagtcgtattacgtagatccagacatgataaagatcattgatgagtttggacaaccacacctagaatgcagtgaaaaaaatgctttatttgtgaaatttgnganctattgctttatttgaaccattataagctgcaataaacaagttaaccaccaccattgcattcattttatgttcaaggttcagggggaggnggtgggaggttttttaattccgggccgcggggcccatgcattgggcccggtccccacttttggtncctttagngngggtnaatgccccctggcgtaaacatgggcatagctggttcctgtggnaaatgg

SEQ ID NO: 3842 - DNA, 464 bp, Homo sapiens
  misc_feature (1)...(464): n = A,T,C or G
ttatnctttgaaacacnctacttgttctttttgcaggatcccatcgattcgaattcggcacgaggaaaaggccccagaatgggctngcttgaactggaaaaacacactttctcatcccttttggaccacgagcttcttgagagcaaagcatgtgtttgatattcctttgctcaccctcaggccttgtttggcaaattgcctgggatacagaaaataaggacaaggtctgggtgtagtggcttatgcctgtaatcccacactttgggtgaccaaggcaggaggatctcttgaggccaggagttgcagaccagcctgggtaacatagtgagaccttgtctctgcaacaaaatttaaaaattagccagacttggtggttcccacttgcaatcccactatttgggaggctgaggcgaaaggatcacttgagcgcaggaatttaaggctgctgtgagctatgattgtgc

SEQ ID NO: 3843 - DNA, 759 bp, Homo sapiens
  misc_feature (1)...(759): n = A,T,C or G
gaaatctttatcanctacttgttctttttgcaggatcccatcgattcgaattcggcacgaggctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacagccccaaataacaaatgctcttttgtgttttgataggttggatttctgtttgcttaatattgggaatactggggggaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtcacctgtctatacaactctcctacccagcttgacctcacttttcatacctgatgcagcaaaacaattcaatgccataggagaaggaagcacatggttataagtgactaacacgatattaggcaatttgtccaaatttctcattttctttataggtaaagaaagcattcttatttgattaaat

SEQ ID NO: 3844 - DNA, 954 bp, Homo sapiens
  misc_feature (1)...(954): n = A,T,C or G
gggnnntttttttggnnnaaaaanttttttttnccccccannaaaaantttttntttggggnaaaaaccanncccccccttttacctnngggggaaaaacccttttncnccnnnggggcccnangggggnaaaaacccccccccaaancccgggaaannttncccgggggnaaggcccaaaaaaaangggnaaggaaacttngggnnntnccctcgggggnngggaaaaaaaatgggaatggtaaaaatgggggcccaagganntaacccaaggggnccaaatgggggngggggggaaagaaaaaaagnaaagggggntnncncctcccctaaaaacncccaccaangggggggaagccaanggaantttaccccnngggcaagggaaccaataattaacccttggaattacccgnggnnacccgggcatctgggaaananggnnnacncatgtggagtanaacaanggcggctaatcaanccaagggggccaagnggggcacacatncatncnngctcctggaaccngcatatgcnatgctctcctctagaacactngtccattngccaccggctcntcacatgaccaaancctacattggctccaaaaatcnccangtaaaatggcacttccccaaagaagggggaaattttnnaaaacccccccccgacgcaggccaaannggaccccctgggctacttaancanagccatccccnancaanacttggnagcactnaaaagnagangggggganaatanctgggncggacaacacggcnactctngggctcaggattaagngggaaagnggaanaaactggggttntcaggacnggantccaactctaancgggggggttaaagggaaaaaattcnnggactgaaagggggnggganggggggaacnggctccagaaaaaggaactccataccctcctttaatcacagaca

SEQ ID NO: 3845 - DNA, 828 bp, Homo sapiens
  misc_feature (1)...(828): n = A,T,C or G
tgttaggcaactgatgactatacttatttcacaactggtaatgtgaattattattgcataaactatagtgctgaggccccagtctttacacttccatttaataacttcacagtttcatatcttcttgagatacttactaatttcaagtcccatcttggtcacaaggagttgtgaattagagaacaattaatatcaccagttaaagaagttagattagaaatctgaaccatcctaaacataagaagtacctgcatcttcagagtcttatcccaaagccgttctgctaaattgttcaattttctccatagcagagctttccaggcccttatttggaagtgatttatctctatgcacagttatgtatggatagtatacataatactagcaagtgttattacctagtgttaactggtggngtatttacatcaaaatataacttaatttatcgatatctttttaggggtttcccattaatcaaaacacgtgatatatgtaatcagttgcangttttctgtgactgngacagtagagagtccttcatcctctgaagttgaagaaggtggatgattcttcanagagtgttcatgaaagngcctgggaaaactagtnttgaacaagaagcattaccgggaaaactgggaggagtgnctaaagccntttaaaggaagaaagaatgataaggcttaagggtggtaaaccnantcaatgaacctgggacaatgaaaaagnccccctttaaaaaaaaataaaatttntntttggtttggaagcccttcatgcncaggcatttgacnaaantnaancccgggatgaaaaaaggggtttttg

SEQ ID NO: 3846 - DNA, 1046 bp, Homo sapiens
  misc_feature (1)...(1046): n = A,T,C or G
tngttaagcattcaattttnagatncatttntcacaaatgcatgattctggccctnaaatccgnatatnngcatatntncccnttcaggggggatacanaaatgggnntatgcacacactantcngngngcacgnaaatttctggtgggtgnaactggtcggctnatgntngtaaaatggntcnatagactatctgnancacanngnanntnttncaccctgnatgttgaactatgaaagatcctttntgcgcttaattntacggntaaggngcaagntnttggcctccaaaccnatgtgtntcataaatgtgccanacntaaattattnttgaactttttncagaaatactaaccattaaanggangtnttcnagattggcaacntaatggcaagccctataatttgcacacttatttcntgcaggngatggtatttggttnatcaagggcatatctggtggcccagaatcttttggtaaataaattngaaanaaaaaccccatttaaaaaaatgaaggnggaaccattcnctttnaaaatcaagcnaattnggcttancntttaaaaattaaccncctgggttttattaacncgggngggtaaagtttnaaaaaaaaaaaaaaaaatttttttaaanggggaaaaattttnaaaaggccntttaacaangggggnaaaccttaaatccttttccantnaaaaanggncccctaaaaaaaaaaanggttacnttnngtnaaaaataaaanttttttaacccccctttccttnggggggccttttttcattntttaatncccccaaaatttttttttttttttnaaanggagggggggggnannnntaattaanaacaatnaatttttaaanaaanaaccangggggtcttttggctttttgtttggccccaaaaacttggggaggtgccaggggggcttttttnaaaggncccccaattctttanctttacctggtagangggaatccctttgcttggcccccattctttttggananaggnttgggggaatatttgggcctttn

SEQ ID NO: 3847 - DNA, 1021 bp, Homo sapiens
  misc_feature (1)...(1021): n = A,T,C or G
tacctgatggttgnnttnctctcctgngctgctcatgtctgcttaactacctactctancagcaccaggnagnaggaataatatgtctctttcatgataaactggcttggaaggccttntttgtacatgcaatgttgnancttcaggtntccaaggtggataatgttggncatnancatcttgctttggggcttgtnnttcnaagactcatatgtatngccctttntttattttnaagncntctnantggcccccaccngnngagttttcttgaatgcttcnngagaaaatttcccanaaanancgnctttnaccncaaacttcccccttatgggntaactttancantaaaccccggaaggancntttaattcngcnaacccantanaaaaanttgnatcntttgggcnccaaantnntttaggttaanctncaatgtancnannancctgtntntncttgtaaattnntcaccaagnacnntnttgtcnattgnccacgttccntnnggnnggtccnctatttttgggtttggttaaaangaagggctngncntatnggggccncnngnaaaantgccccnanntcttcnannaagnaaccttgnacaaccaanncccttcttnagnanttcnnnaaaccanttgcanttgttcnggctngctttgtaatttncaagncaattctttngnntaacccatngtttntnntnncagaanagggaaattccccggcntcaattaaaggtgggcctggcnangatttnannaaaaannnnaannnaaaatnatngnnggcctttttnaaacttnnnnnggatggcggatttacnnnagtantnnccnngcatgtnantagnnannacatgtgnnttannttgggaaccaanccccaccttnnnantggcgtgnnnaaaaaaatagcttttttcgggnaaatttgggcaggcctatggnattattgttntaacatttattngctcnngatnnannnttnacnccacnntcgcctctatttctnc

SEQ ID NO: 3848 - DNA, 898 bp, Homo sapiens
  misc_feature (1)...(898): n = A,T,C or G
tttggtcctggagtntnatctacttactgncatcttccncggnctntggcngtgccntgttccatgccgcngtgaggctatatgagatgcgccttggagcngcctggatttttngnntgtaacacngtgggctgacttgtgnntctatnnnanatngccgattatacaancnngngntcnctggncaannactantgnttnagagnnntctnnaacccnnnccgctgtnncngctggnctgancnganggncttgtgtgcagtnactgnttcccntttnccaggnnnnngccctnganngcatactntnntgcctgtcncagtgtntnngggancnttnnntcannganangtctcnctgaccngnnaaggaacatntntggantgacatnngngnantctctngangtatggggaaacccanganngtggtcaataangggccctacaaacatgtttnggaaggctcctanggcattngggnnaaacatntncacnnnctatacaagtggcttnncaaagngaaagcggttattcntntantaactcncnnnacnggacccannantgaccncggcttgnnaccntgnnnaacccnntcntngaactacgggccnttaangaccaaccanggttggttcttgccaccattttcttntgccanccacaaacctggccttgggnaaattttncggttgcattantaaaantganggggggctanctgcttttgggccctctttcnaccttntttntgangtangntttttcntttttantcncgnncantngataagaatancntttgggttgaagttttgggtnccaaccnccttcttntnaatttctnntggaaaaaaaatnnnttntntttnggcgnaaatttgnngnangcttnt

SEQ ID NO: 3849 - DNA, 804 bp, Homo sapiens
  misc_feature (1)...(804): n = A,T,C or G
gaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagacttcatcacttcatagctctgtagctttagggcaggttctttagcctctctttgtctccgtttcctcctgtgtaaagtagggataataaaagtatccatctcactgggatattttgataattaactgagttaacccatgtcaaacatttagaacagtacctgacacacagtaaatgctcaataaaaattacatattgntatattgctgttctagtttataagaacaggtgtcagaatccagttttgaaatgaaagcccagaactgtgagaaatgatggttttctctattagatgttctaggaaataaggaaacatcaagaataatacagccatgcttagaacaagttaaatatatgtccctcttggctttggactttctctgtcacttccgtgctggtcttnctctttccagnctcttcatactctaatctctggtctcagcttctacttggactccntngaagggatagaaaaaaaaaaaaaaaaactcgagcctttaaactataggggtcgnntacgtanancc

SEQ ID NO: 3850 - DNA, 840 bp, Homo sapiens
  misc_feature (1)...(840): n = A,T,C or G
ttcctacctgcnctggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtnctccagtcccaggtggagaacctgctccacagaacctactgtatgtggaagaacaagagtccctccccagtccatggggcaggcccctcggtcatggagatcccatgggatgatcttatcgccttgngtatcaaccacaagctgagagactggacgcccccccggcttcctgttcatcagaggcgctgagtgaanatggtcagatattgtgtgtatttttttaaaaacgatttgaaaaaatatgatgttcctttgtcgtgggaacaagccangttgcanacgcanaaggagctacagctgatagagggacgtttggcaataaaagcctttttcatccttctgcaaacaattttcccataccattgcttcacatncaccggacttggaagaggagcacagagtgtgcttnagangggaggattcccagcacannaggatctgattgcgaaggagcttttgctgagggagctctttggcgcagtggtttntcgagcantcttgcttgttggggnaaagaaagaaaaccaagagggtttnaanaatcagccttcaccaatggntggtttgaaagaactcaggangccttttacgggttttaaactttccttncccctnttnntctttcctcagacttttagnggtntctttttcacactnttggaacn

SEQ ID NO: 3851 - DNA, 841 bp, Homo sapiens
  misc_feature (1)...(841): n = A,T,C or G
tttattgacgggaagaggtcatctttttttccttctgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcanaagtagtcccagctcataggtgttcatactgttacatccagaacatttgtcaggctctctgtcagctttcatgtacatatggtatagaaacccatggagttaggcacttcctggattttttttttatgagaaaaaatctgtatttaaaatgtaaaataaacttttaaaaaagcanggcnctaatatatatttcttnccgcctttgattaccaaatttgtcccttgcncatggttaaagatgaaattatcttcctaaaaaatatcaatggttcttggggaaccagggggattgttacntttaccataaccaacnggttncctggcaatggggttcatggtcaaaaaaattttttgggttttnaaacttttnttatttgncctttggcttggtggattaagnccaagnncaaagngccgaattnc

SEQ ID NO: 3852 - DNA, 796 bp, Homo sapiens
  misc_feature (1)...(796): n = A,T,C or G
gataatgaaaataaaaattttgtgggctcttcatagtgggtactttgattatgtgtgataatactgtgctgtgacaaataatataatgaagaaattaataccaagattgctattctgaaagattaaacattctttaatacttagatctttcatctgtttatgtaacaaaccctaacatacaggcttaatgccttgcagatattaacttctttaacttaatctttgtaacagtcccatgaagtaggtctattattattacattttccatttgaggaatataagacataaagatattaactaccttgcccaacagctaattagtggtggagcctacttttgaactcagacactctggctctagactcttttcttttattaaccactgcactatgttacattgtttttttatttttaacttaagtgtgttaaccttgaatttgaattatgttgtattagcctggtaagtgggatcacagaaacgtgtccactgcctagatggtaagagatcatttgtctttcatctttgcatacttaacatcaaaatataaggaagaacaaaggaaatgttaatcttttaaagcctcaaagtataactccttttaaaatgctaatgattctggaaaatggtcagacctttaactgctttagttgaacattttagacaggagctaatatttttaacaaggatagcaggaatcatatgttttatttctgatccttgacaaagctgaagagttgcatcttcataagggnttcactntntgntacacactagactacttgcaaggggtgcccn

SEQ ID NO: 3853 - DNA, 827 bp, Homo sapiens
  misc_feature (1)...(827): n = A,T,C or G
gcatatgtgggaagtgngtgtcccgtccaggcctgtgcctcggnccacagcaactgnttcgtgtgctggagacgcccagaccgacaggcgaatggntcgagtgcacctcgatccgagtctcagcacctagactaattaggatgacctcagagatgctgaagagtacctttggtcagcctcagnctttttgnttttggttttttttgagactgtgtctcactccgtcacccaggctggagagcagtggtgcgatctcagctnactgnagcctnaacctctcagactcaagctattctcctacctcagcctcttaactagctgggatcacagacatttgccaccatgcccggctaagntttgtactttttgtagagacaagggtttgccatgttgccaagctggcttcaactcctgggctcaagtgatgcctgcctcagcctccaaaggtgttgggattacangcgtgagccaccgcacctggcctgttattttttaattagctgnggaatttttttttccanataaaatattataaaatttattaaaaactttatttctcaaganggggaacgnggaaatactaattccccaaatggttccttttacatctagaggtccaaattttccncaatngaaacntttctttcaattttcggtactttttttggttggtttngagaanggaagtcttgntnttgtctnccaggctgggantacaagngagcccgagaacatgccccctgnattccanctggggngacaaaancccgacntttttttaananaaaaanangnnnnnnannnnaaacccgggcctttaaaatttt

SEQ ID NO: 3854 - DNA, 826 bp, Homo sapiens
  misc_feature (1)...(826): n = A,T,C or G
ctgaaagggcagcgggcagaaaccgggctggggctggcattagctttccctcctcccagtttctctccagcgcagcagggcacctctagcccagaaaaagaaaactgactttctcttatttctgttttctgctgctgctaatctcctcctgaagggttgtgtggcttcttgggactctggaaagaaactgcaggggacgaggacaaaggaaacagctactgtagtcactgcagctatgcaggctctgtgctagccctggaaaggcctggacgttcangtctgctgtgccgggggtaggccccagaacagagcggtgggcccatcgctctgcaccacagctgccagggctcaaaccttggctctgccttacctggctttgggatcttgggggatgcacaggacactctgtgcctcaattttcttatcttgtaaaatggggcaaatacctaccaagtcataggggtgatgtaaagtctanntgagataatggagggnaatttcttttttttcttaacttaaattttggatccnttttgggtcgatntttgtatattggggggnaatttcttanaagctngaaagttattnaatgctgcttatgagccaaatactgngccnagggctcttgtccagatcattccagttaatcccacccaagancccaacagcncaaggggttgcttatatttttgggggngganggaactgggaacccnaggggaagtcacgggnctttngcccaaagttacccccgaagttnaagcgtttaaaaccaagaaatttgaacccccaagccaagcttgaccnantttggtttgcttnggcn

SEQ ID NO: 3855 - DNA, 812 bp, Homo sapiens
  misc_feature (1)...(812): n = A,T,C or G
ctctcatggtaatgccagtcatgctcctcagtcatcagaaccagcaaaaatactcctcacatgtccttagatagttgcaaatgctccagagaggggtaatggcactgctcctacttgagaaccactggctcctgtaactgcttggcctagttctaacttctaaaatgttctcctttcctgagagtataatgaagagccagatactttgtgatctttctatcattcctctggcttcttggacttccttaatgattgagctcagatgctggagtcacatcgtctggctatgaaatcaagctctgccatttactgggtgtgaccttgaacaattacttaatctctccgtacctcagttttctcagataaaatggagataatagtgacatccacttatttttgtgaagatgaaatgaaataaagcatgtaagctggttatcacactgtccactggtggaggcatggtaattgnatgaaggggatgacgatgattgacnatgacnatgatgatgatgatggctcccaaccttaagggcttattcnagccagaacttgaaattgaccttaataatgaatactncaaaaaacacagacaggcacatgatntattagaaaangnagcaactacggngggagtcaagtaaatnctaaacaccctctgcctcaatctgtatggntttgaaatgtcctttanccgtcttgatttttacatatctatgaaaattttgnggtncatgggggttaaacaaaatggatgacttaagccnttgggaagtaatttcataaacaaccttgttgatatgtaataaaaaacc

SEQ ID NO: 3856 - DNA, 835 bp, Homo sapiens
  misc_feature (1)...(835): n = A,T,C or G
ttgctttacattggtgaaaaaagtcatcatttcgaagccactcattncatcggaattgggagggccaccatcttatagctgggcttgtgaacctttgacttttcccagtatatattggactattttgatcactgctatatgcttctagttcctcaatcannatctgccacagaggaggccctctaaattttttgtggaattacttaatgaaatgaatgantgattattcgccttcacaggattgtgtgagaccatataangtgtgtagagcggtttgacctcccaccattgaaatgctccttaccattagcatctaaagtgattcactagagaaatgtgtgtgctctcntgacagtctgcttgttccaccttgctggaatctaaatccacgagaatcctgtgttcatttctctctaaagaataattacgaccatntaaggtaatagctaaagaatcnagacctgtaagaactcttancangtacagtggcctgtgcctgnagtcccagctactcangangctaangtgggaggattgcttgaacccntgagtttgnggctgnagtgccctatgattgtgtctgcgaatagccactgcattacagcctgggcaacataagggaggaccatgcctttggaaaaaacaaacaacttnttgggaagtctcctaaataacctatttnaaagaggtcaacaattttgcccggtggggttggcgnggtaaaggacaaaaanttgccattnggtttnnatnttttaaaggnnnnaggggggnggggnnngnnnggnnnnntaaannnngggcccnnggggcccattnanttnggnncccngtt

SEQ ID NO: 3857 - DNA, 772 bp, Homo sapiens
  misc_feature (1)...(772): n = A,T,C or G
ggtgnttnnnccttgaaanctttatacanctacttgttctttttgcaggatcccatcgattcgctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgangtggttcctaggagcaacactttcgacctncagtcttcctgatgacagtactgtctncaagagaaaaatcctcacttattaactctcttttcttgcatctcattttatagagctactcatccttatttggaaaaaccancaccaaaaaaggcttttagaaaatggt

SEQ ID NO: 3858 - DNA, 820 bp, Homo sapiens
  misc_feature (1)...(820): n = A,T,C or G
ctctggctcttggaaaagggcagtgtctctaaacccaggcaaacggtaaatgtggggcataggcaagagggtcccgggtaggtggccacttccccatcatgctcgtttctcattttgtgttttttagtaanaaaaacacagtgtgttcttttgcccagacattaatctttagaatgcctgtattttctaatgttgggatttctttcacaaccacccaccttaatatttccattgtgactcagaaaatcagacttcattcgattctttagagaactataaatactgttgtcagtagagtgaagtcttgtcttatgtaatcctaattacagaatgtgttctcagaagaggtaggctagaccagagctgggcagaccacaggcagaggccaaatccagccccctgccgatagtagctaatataagttttacacccacttgttcatgtattttccctggctacttgtgggcagcaatgccagagtcaagtcatcataacagagacagaatggcctgaaagctggatttactatttcaacttttacattaaaacttgatgacccctgtgctagacaggcagctcatttctgcaggtaaaattatattcatctnccaactttcattncaaaattgaacctatattactgaggcccaaaaaannnnnnnnnnnnnnnnnnnnnnnnnnnnnnnnnnnnnnnnnnnnnnnnnnccctnngccctttaaaaccttttgggggncgntttnccngaacccnccctganaaaaaaccttggtggagttgggccaancccccnctttnaatgccgngaaaaaaattnttttt

SEQ ID NO: 3859 - DNA, 777 bp, Homo sapiens
  misc_feature (1)...(777): n = A,T,C or G
ggtgnttcccctttgaaaccctttanacaagctacttgttctttttgcaggatcccatcgattcgaattcggcacgagggtgggcaggcagctgcacctcattcctgagaccatccggggcagggcttttctgactgagacacacgaccctgacaccagagagaattctgtatttccccacccttgcaggggctgcccctagagaatcccatcgggtgagcccaggaacccacaagttctgcacccctcggatgggtaggcattttgagggcatgaggtaggcgttacagtgataagatacacagggctctaaaccacagaggccccggttcaaatcctgcctcttctaagtacaaattagttggctttgggaagtgagtcaactttgccccgggctgcagtttcctcgctgtcaaatgcatgggagagggtgtgtgaagagttaaaatgtatttagatttcactgtagtgtctcctccaacatgatctcacactccttttacagtataagcaggctgatgtcagaggctgtgactcgccctgccaggtctaagaccgtggggcgtggtcacaggtactattttangactcctctnaccacaggcactgaacttggggcttgcatatatatcaccccattactcctcagaagatactgtaacgtaggatcttttattggctntattgaggcttaatgcatccattttangnggtacaatttgatgagttttgacaaaagtntaancttgtaaccacaatnnccganttcatgacact

SEQ ID NO: 3860 - DNA, 765 bp, Homo sapiens
  misc_feature (1)...(765): n = A,T,C or G
gnnnntnnnccttgaaaccnttatacanctacttgttctttttgcaggacccatcgattcgaattcggcacgaggacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgccttccaggagtcctcagccctggggactctgactcaattgtacctgcagctcctgccatttctcattggaanggactcctctttgggggaaggtggatatccaaccaaaaaaaaaaaaaaaactcgaggcctctagaactatgtgagtcgtattacgtagatccagacttgatagatcattgt

SEQ ID NO: 3861 - DNA, 771 bp, Homo sapiens
  misc_feature (1)...(771): n = A,T,C or G
ggnnttnnncctttgaaaccctttanacaagctacttgttctttttgcaggatcccatcgattcgaattcggcacgaggcgagactgtctcaaaaaaatcaaaaaaaagaaaggggatgtaaaataatcgctgcaagttacagtgtttttcattaatgacttccaaatgtctcacatgtattgtctcttcccagtagcataaacaaagatgcagggaggtgcaatgagttcctacaggccctagagctgacggtaggggtgggaatacagttcacaccgcgtcttcagctgtgttccttgtggatgacatccactggacagccaattgataaaaacagttatcagttctaaagtgttaggacaattacagcttattcaaagaaaactcaattaaggaggagttagtaaagctagtattgttcttatcgtgtgcaatgctgcagtgtcggctcactgcaacctccatgtcccaggctcaaatgatcctcccgagtagttgggactacaggcatgtgccactatgcttggctaatttttgtatttttttatagagactgggttttgccatattgcccaagctggtctcaaattcctggacgcaagcctggatttgcctggctgccatttctgggttttgccgcaattcagttttttatgacaggcagaccagtgagtagaatacagttctttggataaaggacaaactgaagcactaaaaatggagagtcattttaaagcaaaaaccagtggaaatgtgtacttggcttcacc

SEQ ID NO: 3862 - DNA, 707 bp, Homo sapiens
  misc_feature (1)...(707): n = A,T,C or G
ggtgnttnncctnngaaacctttatacaagctacttgttctttttgcaggatcccatcgattcgggaaaaataacatgttcactttatgaaaggaagaaccaggnaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtcagtgatttgtccagaggggggacttaagtctttggtaaggatcgccaacagctggaaagtatttattgcataaaatatgtccatgatactttaccaacattgtagagaatgtaagctataaatacagttatattacaaagagtttacaatctaaaattaaacacaagaatttacggaaaaatcaccaaaacaaattaaatggaaatatcatttcacaaggttctttaatttttggccatatatttgataataaatacatatgtgttntagctatcttacttctcttcttattctgatttnacctnntgtggtcccctgctg

SEQ ID NO: 3863 - DNA, 621 bp, Homo sapiens
  misc_feature (1)...(621): n = A,T,C or G
tgnngggcnaganacccgntngggctgcaagggccggcttgacccnacgnatnccggggcananatgcctgtcnagncnncaaaggaaggttgtnncgctttacgcctattggtggaaaaaancccnttntngaaggtctatcctcaaanngcnnntngcgttcncccgactggccgtttatncaccnctggnnaagaggganttnattnnacccgctcttttttanaagannnnaaaggttcngcatnntggggcnnnngnncacactggctttgaanagcnanagctgagtgacatccacccagatncaaaatggtnacatgtcaactgtggccgaaaacgnggccgcactgncccatccgctcttcnggagnttgtnggccctttatncgcacnaaattgcagcctgccggatactgtattcacacaggctntgaggggggagggattgttntcagaatgcattaagcgcnttnaatagcctgcntcngttgctttgtcaantggtcttnacatgaatgcccgtcccctgaatatcnngtaatcatctatcnnacctgggatcgcaanncgttaaaacanaagggcaagtgacggnggtcgtactgngnaagagctcc

SEQ ID NO: 3864 - DNA, 790 bp, Homo sapiens
  misc_feature (1)...(790): n = A,T,C or G
ggngnntnnnnnntttggaantctannatacaagctacttgttctttttgcaggatcccatcgattcgctcagccccccagtttttatgtggacatgttttcatctctcttggatatatacctaggagtggaattgcttggttgtgtggcaattctatgtttagcattcgaagaaattcattgaatggtaagctgaaaagtgacgtggttgaatttctgatttcagaaagatcactgatgtgatgagaatgaataactctctggagtgctaggatgtgggggcagggagctagcttagtatattattgcaaaatcttgccaaagatgagctgatcaaatgagaggaagcatgaactaagaggggagcagcaggagtggaaaagagagatataatgatgctagtacagagtttatatttacagaacttgaaatgcagctcangagtgggaggagtcangtggtgccaagcctacataaatgagcatggtgttgcttttgacaaatagggagaagcaganaggggaataacattttgtagtttcttaatttctaatatgtcttgagataggtctctaattatatgcagctcaattnacagatgaaagttattggtttatcatgcattcatctttatgaaaagaaaggattcggccttgcttcttccttggtaccaaagtattggncagggcttgggcacngtggcttacacctgtaatncccagcgcttttgggaggctnangcaggaaaaatccttggaccctgggaaggtnaaggttccantgancccan

SEQ ID NO: 3865 - DNA, 766 bp, Homo sapiens
  misc_feature (1)...(766): n = A,T,C or G
ancctttanacaagctacttgttctttttgcaggatcccatccgattcgaattcggcacgagagtgactacttagaagatgctgtccccaccttcgccccctccctctagttgcccaaatgtcttacctcccccagcttcactcgggctagtggaggtcttcttagacttctttcaaggcggaggatttagagtctggggtgaagtggcggtgatggatggctggggacgtggggctgctgactcaatggtgatacatcaagcagttaattaagggacaagttatcttctaagtgggaggtaaaggattttctgttcctttgttcttaatgctcatattaatgccattttccctcatggagacctcaggctgtgcttaaaacgcttccataattccttttggcactgctagaggtcagcattgtccactcgtgaaggacacaggtaagtcacagacattggggcttctggttgttaaaggccaagaatgtgggatgaaaaccccccgtgtccccatagcaagttaggggttgctcancagggctgttttcattcagacaagcagctcattccaaaccagccccagagagccgcttcaataagccattgtctgcccaaggaggaagaactgttgtccaaggctgtggntaatgcatgacattggtagttgttccaacaagtcaaaacttggttacagaaaagcagcantgacnaggatcttggaataaatgccttggacccangtgccaaggaattttccacgcatn

SEQ ID NO: 3866 - DNA, 1154 bp, Homo sapiens
  misc_feature (1)...(1154): n = A,T,C or G
tattgatctcacctgctttgagtccatcntcaattcgncaagccnggtcnagagtaactctgcactcctagctgggttgccttaacaagtctatttaactttttcttagggtatttctaagagagttccaaaatggaaaaaaaatnctatggtggtntggaaattttaatgaataataaattcccattttaaggttaaaaataacccaaaaaantaaccacctccgtantccattaagancattttaggaagnaagtttncctttanctttnggggaaaaagggtttttccaattttttccccttnaaaatggganccanttccaaccttgggaaaaaanccaaggcccaagggggttaanttggaaacccaaggaaagggggggttttnccccccccttgggaaccctttttttgggaaattaagggnttttttttaaaaaaaattttaaattcccnttttaaaaaattttttnaaaatnccccccttccctnggggttttccccccttccnttgggccccccttttggggggggnccctttttaaatttttaaaaagggntttttttttngggnaaaaaatttttnaaaaanggggggggggtttttaaaanntttttgggggggaaaaaaaaaaaaaaaaaaaaaaannaattttanttttaaaaancccccccagggggggggtttttttnaaaaaantttnancccaaaantttnccgggntttnaaaaaaatnaaaaaaaattttccccaattaaaaaataaattaaattttnttaaaaatanccccncccctttaaaaaaaaaatgggaaaaaaantttaatttanttttcccccaaaaaaaccttccaattaaaantttnaaaagtttnttggnaaacccaaatttttggccaatttttggaaanaattttttaaaaaaattnaaaaagcccctnaaaaccaattcggggnccccctttcccctttctttcaaatnaaaattnaattttcctccccgnaaaggggnccctttttcctttccctttgganggggccttgggggaagcccnncccaaggncccttttggccagcccccggnaaaggggggtcctggcacccttannctnggggtttttncctttccccctgggnnanggggcctggna

SEQ ID NO: 3867 - DNA, 917 bp, Homo sapiens
  misc_feature (1)...(917): n = A,T,C or G
gtgattccattngatacagctacttgttctttttgcaggatccctcgattcgaattcggcacgaggatcacaccactccactccagcctgggcaacgaagtgagaccctgtgtcaaaagaaaagaaaaagagaaaagaaaagaaatctgaaggtcttgacaacccttggtcccccatcctcctatgactttgggacctaaatcagagctggccctctttgtaacaagggtgtgggcccctctatttcactgtantctgntttcattccctgcagccctccttgatacgaaagatgccagtgacagggccaggcacttgtggctcatgcctgtaatcccaaggaggccgaggcngggcagattgcctgagttcacgagttcaaaaccagcctgggcaacacggtgaaaacccccggttcctttcntttgggcccctaagatacaaaaaattaccaggcatgttggtgcattgccttgtaggtccccaactactcggggaaggcttgaaggccaaggaanaaattggcnttggaaacttcnagggacaacaanaaggcttgccaagttggaagaacaaaggaatngggtggcccacttggcaattttcttaagccccanggggcntttccagggaagccnaagggaactttcttggttcnttcnaaaaaaanaaaaaaannnnnnnnnnnnnnngggggnccccctttnttttaagnaaaaaccctttnttttaagntngggaaaggttncccgnttaanttttnaaccccntttaannaaatttccccccaggaaaaccantttgggatttaaaagggaaattcccccntttttgggnattggnaaaattttttttgggggnaaccnaaaaaancccccacccaaaaccttttaggaaaaantgggcccaannttggg

SEQ ID NO: 3868 - DNA, 847 bp, Homo sapiens
  misc_feature (1)...(847): n = A,T,C or G
ttgatttccatncagntactgctattgttctttttgcagtatcccatcgattcgaattcggcacggaggtgagnaacggngaatacgggtaaaacccttggctcatggaaagcatagcncaacataaaccttttaagcaaaccagcgcagagttcccgtcataagtggccaccatcttcagaaaccagggctcntgggtgtntccanaantttgccaggaatttatgttactttaacccactttggtngggggaaaagcttttgnaaatagaatcatacatgcatttggtttttaattacagtgccgttggcccatnaatggggnttaaatttatactggagcacatgggcacccatatctgggggtttccctcttgggtcaagggccccccattggccaanaancagagtctaaaggaaaatcttgaaggttgaaaaaccnttggggggaaaggnaaaaaantcaaaattcccagtggggaaaaagaaggaaaaatagggangggcttaaaccttgcaaaaaaattgaaaaanttgaaggggtttgcttggtcnaaataatcttggaanggggcccctttttcttgcnaagaaggaaggtgnaacaatgggagnacaacatttcaaattaaaccattatttggtaaaaacnttncttaaaaagtcaatngnccatnccanaaaggttggaaatgggaggggnnggtggtttctttccgttccaacttggggagttcttggccaaaacttttttggaaggggcnttgttttctttttggaaaagnaaattaaaaggttnttttgggaacangggncaatttggagtttntggaatnccccaatttta

SEQ ID NO: 3869 - DNA, 661 bp, Homo sapiens
  misc_feature (1)...(661): n = A,T,C or G
nttgattccatnntntacngctcttgncttntgcggatccctcgattcgaattcggcacgagatgaatgtggaacttttatttttatccattattttcaaattggatcantgtcctcctgatctattagatctaagacctaagaggaacctaccttgttttggctagcgggtacagactttcttactaaaaggngggtgtatttcctagaatagcatnttctgttgagtagagatgattntcaacaatgtggctgngtcacttnncttcaaagtgattatngagtgtgaaagtaagcanttgtaatactttttaaccactgtctgtgttcttaccagatgggaaaacancactcgtcttgaaactggaagttcccagtcctgggatgatctganaaggttttggaagggaaaaaccccttgttagagatattgcagttgcatcacacaccagcttgggtgctgcctaggatcanctgctcagtgaanagtactcttgctaaaccttacaccacccagactatgcgatttggataagtaatacttatcttgacctgtgttcttttgangggaaagaatgnctattgggtaggattattgnaaaatgagatgagatatccttataaagttttagcatgatgcngcctctaataatctgcatcn

SEQ ID NO: 3870 - DNA, 803 bp, Homo sapiens
  misc_feature (1)...(803): n = A,T,C or G
ttgaattcaatacttgattcgattttcanncttggcgggatcccatcgattcgaattcggcacgagagtgctgggattacaggagtgagccacttaggctagccctgaaatgcttttgtttttgtttgngttttttgttttttaatgaaaatacagggacatggagatgtggaaagacaccttgctttattactggtgttattattattattactacagtataattcatgtatcacaaaattcacgatttttaagcatacctttcagtattttttactatattccaaaaagttgcagccagcagcactacctaattccaaaatatttcataatgccaaaaagcatgcctgcnctattggctgtcactctgcaattcccccttcttgcaggctctggacccaacccccncccctttaaaaaaaacttctttctttntgtatagatgtacttggtctggggcaccttcctctttatnngaaaaacaaaatgggggngtttttggggtttgggttntcaaaanaaagggnccncaannattnaanacccttttaaaccccggccnnnaccctttanaaantttnttngggcccaaaanaaatntccccccttatngggggtaacnnccaaatttggnnggnnntaatttcccaatttnanaaaccaaagtgggtttttnncccccntttttttanaaaccttntttttnntggaaaaataaaannggccctggccntaannnaaaaacaagccttttttggcnaccaattggttttttttngggaggtnggnnaaaccattttttn

SEQ ID NO: 3871 - DNA, 834 bp, Homo sapiens
  misc_feature (1)...(834): n = A,T,C or G
cttnttctactntttctncctggaaaaccgncnnntgcaggacccatcgattcgaattcggcacgaggggatttgaatgcccatgaaatacatttttttttacttgaatatattcttgcttcactttaccctccataatatgttgtncattagtgctgatcaagtttacagagttacattttgctnncctaaccattcaggcaggaattaaaatatggcattgttaacaactgggaagaagctcatagnggatatnaattanagtagataatgggtcaccttgatagcctctgnttacatcacttgnatatgggcaaaataattattacctatacgtgtatttaagcttaatttncatataaacagtnttttgaatctatgctaaaanagataatatctaaaagngtgatctntacgtagtccttagtttatnagtctgnactncaaaaagattcttaaataagcccggcacggaggctcatgccngtaatcccaacactttgggaggctgaggcgggcgaatcacctgangtcangagttcgagatcaacctggccaacatggtgaaacccngtctcaactaaaaatataaaaaatagccccggccgtggngggcangcacctggaaatccccagctactcgggaanncttgacgccangaaaaatcacttgaaaccccaaggggcaaaaagctgggagggtaagcccaaaanccgcattnattnggacctcccaancctaagggggacaaagaaacgcgagnacttcaatcttaaaaancnnntngncanttattgncnnaaanggnaatgnngncccggaaaaaaaccccc

SEQ ID NO: 3872 - DNA, 970 bp, Homo sapiens
  misc_feature (1)...(970): n = A,T,C or G
tgtnagacgtttcaaggtcagtgtattagtggctcatgcctaggggaaggaataacatttggagcaaacaggagacaaattgaaaagcttcaggaggaaaggctaggaaataagattctttgggcgagaataaggactttaaagagattccacatattcctgggaatctgaaagaccatacacatgcctagggctgggcatgtgcttaaaaagacttgagagggccctatgctgtcacctctgcctgaccttcaggctctgtgcaagcaggaagtgaaggctaaggcatagttataaactgcatgggtgaaggttgaaaggtgtgtcccaacacagaacacatctgcaaatgctacgaggcattttgttgttccaagtgttcaaagaaatcttttgaatcactactgaccactaagctaaccaaagacttagtggccacacctgacaaagaatacaaactaaaaaactaaaaatgtagttcaagaaaataacaggctgggcacagtggctcacatcggtaatnccagcacttttgggangctgaagcangtgggatcttctttgaacccaaggacntttngagaccagccttgggcnacattggcaaaaaacccccatcttnttgnaaaaaaaatactttaaaaaaattttgccagggggccctgggtgggcnnccccacctttantaggttncccaagctttncccccaagaaaggccttttaanggtngggggaagggaatccaancctttgancccctttgggggangggtnccccagggcctttttaaattggnagnccccattaaattcccttggncccatttgggcanctttccaaacccctttaggggnggnaccacccanatgggggangggnaaannaaaaattttttaantttttcccnaaaaacntttggncccnccattttttttaaaaatnaaattttttttccaaaaaaattggtt

SEQ ID NO: 3873 - DNA, 807 bp, Homo sapiens
  misc_feature (1)...(807): n = A,T,C or G
actgaagctgccaggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggacctgagacccgcttttccttttcccttcattcccttgagagtcagccataaacggaatacctgctaggttccaggaatgagctcacctaacagacagcaaatgtgtctggttagatctcagcagagcccattctgcaagacctggctganccagatgagagggtgggccctgtgctggggggccttgggtcacacacaggaaccaagacctggcttccaccccccagtcacccacttgggttatctgctggaagttatcgataggactgtgtggccaaccaagtgcttgtgagatcactgacactgcaaaaacaaagcaaactgctccgggtaccaggacttccttcaacctggcaangggtgtgcgctgaggcngggcttgcangtganggggctgtatgcttcaggaactaactaaaatgcatgcanaaggtaagaggcatgatgggaggtgttcaagcacacaatnccatttgggaggttattttgatactgcgatgantaagggtaanggccccatggaatggggctaanggtgggagtgaacactggggtgaataaattttaaatcaattcaggtaaaaaaaaaaaaaaaaaactcgagcctttnaactatagggggcgtnttn

SEQ ID NO: 3874 - DNA, 461 bp, Homo sapiens
tatccatcagctcttgttctttttgcaggatcccatcgattcgaattcggcacgaggagaaaagctctcaggtaatctgtatggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttattgatcatctgctttaggctgggctctatgttaggtgcctgtggattccattctagtacctgtgttctcatagaattgaatcctggtcccccatatgacttttgatgatattcacactgttaattccaataaagacagagtagacaaacagaaact

SEQ ID NO: 3875 - DNA, 833 bp, Homo sapiens
  misc_feature (1)...(833): n = A,T,C or G
cttggtgaagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcanaggtggcagggccctatggagcaccaactgccctcaaccccaccctgtgcccaagactgggaagggattgatgtcaggctgtggccataggtagcatgagttgcccaaggagggacagagcatatctttgctgangcttggctgangggcttatgatanggcttgcagtacctcacaancccctgtgggcacaagacaccctgaggtttacccaggccaaatatatttgattagcagggaaaaaaaaaaaaaaaaaaaaactcgaaccctntanaactataagtgagtcgtattacgtaanatccngacnttgaataagaatccattggttgangttttggacaaacccncaacttnngaatgcccgtggnaaaaaaaatgcntttatttgggnaaattggggaagcctattggcttttntttgtaaccattttaanctgcaattaaacannta

SEQ ID NO: 3876 - DNA, 833 bp, Homo sapiens
  misc_feature (1)...(833): n = A,T,C or G
gtttgtgggtgaatggtttcacaccagagtgggatcctctattgcatgtactcgactagcttttcattcttatcacacttcccttcctataaagttacgtatcttttaaagggaaatttaatacccaccttcgctttctgtgcggccttgtgaaaatcaggcaataacaaggacagccttattgccagtgtatgaccagagcatctagatggcactactagtggaatgtcatcttgtctaccattcattcattcattcatgattttctctaccanacagttttggaactcctagaatgggtcaggtggtaggcaggcattgggaaaacaaggttttaagccattgtccaaatcctcaaagaactcaccattttggtcgaggggccatggtgagaggtgtatagaacaaagtaagaaatgctgtangagcagagagagagaaagaggcccagagagcacagtggcagagtacatctcatccagagaaacagcatcctgcatcctccagagtcctggttccttcagtttcatnccctttcttcttcttccatggattatgtaatacattgtaaaggttttaattaattaaaaaattgaaaaaanncnaancnnnnnnntnnnnnngnnnnnttnnnnnnngnngnnnnnnnntnnnnnnnccnnnnnnnnnntnaannttttnnnntttnnnaaaaannnaaaancnaaaggnnnnnnnnnnngnnnttngacnnnngnnnaaantnanaannnnnnngaaaaaaaanaaannanntnnnaattnnnnaannngnnnnnnntnncncnnccnnnaannnnnnggaantnnaanan

SEQ ID NO: 3877 - DNA, 1213 bp, Homo sapiens
  misc_feature (1)...(1213): n = A,T,C or G
cctttnaanggggntttttttttttgggggtttaaaaaaaaaaaaatttncccnaaaggnccccntttngggggggggggaaaaattttttttttccccctttttttccccccccttttttttttttttttaaaantttttttttccccnaaattttttcccccttttttttttttaaaaaaaaaaaaaaaaaaaaattttttttnaaaatttttttttttttaaaaaangggggggttaaaggggtttaanccccaatttgggttttaangggttttttnggggggaaaaaagggaaaaaaaccctttanccctttaanttttnaanaaaaaaaaacccccaaaanttnantttaatttgggttngggggggggaaaaaaaaaccctttttcccccagggccccccccttccttggggggttnaaaaaattngggtggggtgggtcccttccaaaaaaatttttgggnttccttgggggaaaaaaagnaaaaanggggggggggaaaaaggtcctaatggaaacccgaacttttttcaaacctgggccnattnccatatacccaatgggttaaaactttggattcttatgacatattcctatgaaaataataaatactggccttttccttgcagaaagcctcagacctgaatcagagaaaatcatatgccaaagccaactgccagtgttagacctctttttncataaagagtaaatgggaatgctaacactagtgggcttattgagaaaatttaaagggtgctgtagtgtttagaacttaggctggaaaaccatattttagtgcatcattttactacatgatcttccaattagatagcttgtaatctggtccttacagcacttgctgntggtacatgtgaagattttataaattttaaggaaaggtgtctatgatatatagtgaaaagtgtgggaaaagaatatagaaaataatattcacttctnaaaccattatgataaaaatatttgtgtatnggattaagaatagaaaggggattatnggatggtatctatttcaatttctcagnttatggttngggccttnccttttttggaaaggtacccctgggttattgcctattggaataaaatggatatnaatggggtaaaaaanttnttcaaaaggncccnaaaaatggaaaatnccaaaggaatttcccttcnttttggacctanttttaagggnaaaaga

SEQ ID NO: 3878 - DNA, 972 bp, Homo sapiens
  misc_feature (1)...(972): n = A,T,C or G
tccaccctgactcagccttggtgcagagtgagactctgtctcaaaaaaaaaaaaaggaatcagtttgggtcttggcagaaatcaacataagggaatntgacaagaaccccagtaggtaaccctgagtgctcaaggtccgagcctgtgggtctcttttacggcttcatgaaaaggaccgtgccctcacnggagggggnacccaccggctttgggctttgtggggggtcttaaggtgnatggcttgcccttctttttnttcantcaacccacaccccaagctttttttggcttgggcactttnangggggaaagaagaagccancccaaaatggagnaagaattttaacccttttttaatcttcccccaaccggaagccgaaaaaatggtttttcccccttggtttncaanaagnangggaaagttaacccantccccntttantgcctttggaacctngggggggttttccttttttggttngggttgggttttgggtttttttnctttttcaaatttgggnaaattncttggtaatttttaaaaaatggtttattggtccagccttggaacaccattggggnacaacntccttgaaaaaaggtngacttgggcccccccccccctgttttgggccggtgaagttttccgnaccaccnggncttnaaaaagtggtcccttcttgctttcgtctntttgtttcncttgcttttgtaaaaactttnggtcccaagcttgaanacattggctttgtaaaaacgtngaagagtcaatnccnaangggggttatttgtcanaaanaacttgncctntgccctttanccgaangcagtcnaatcntgccagttggatttttcttactggnggaatgacaagaaacagggattnattttgcncttgcgganaattttccgggagtgnctntttaatattttnagacccgattctttgacatnttanttgactccaaaana

SEQ ID NO: 3879 - DNA, 884 bp, Homo sapiens
  misc_feature (1)...(884): n = A,T,C or G
gggtaatattttgttttataacagtgattcagtatatctgaattatggattatatggccatagaactacaagcaaaaaggatacacaaacaaattttgtagttaagacaaatctgttgcctaagatcaagaaatgtaatagatggaggccatgtagaggttagaaattcaaagaaatcgaggtcaaaaactggccaatcataacggcatagggattagttcctaaatttggtcacttgagaataacagtgtgaatagagtggagtggaagatgtgactggtgttgtttctaaaaatgtagaattgtcctcttagttggggtctaggtagtttttgagaggtgaatatagacactaactttttgttttacaactgaaatcaaattgattggtaatttgcaacaaaatattttttgaccccnccatttatatcttaccatgtatattattttcactnggntgataaagcctatgactacctcgtcagaatacatcatttgctaataaattagggtttactggtactgntggaaataacccgtggcattctaccctccgagaatcctgttcaggtggctgcaccctttcaaaatccantgggcgtttggccatttgnaanccttgtntttttnccgggggaaaccaccangggtcaagtttanttanggccttggcccagttaaggcctggaccgttntttccccaattttgcttggntttggaaatggaatngggttttcatttaattnaaagaaanttgcttgttttggggccccatggttgtggaaaaagnaattcnntgaaattgggccggttttgaattanttttaaatcnttantccttaagaaaaaaaattttngaanccntttngggggccnttgtccn

SEQ ID NO: 3880 - DNA, 998 bp, Homo sapiens
  misc_feature (1)...(998): n = A,T,C or G
aanaaaattaangngaancctttaaaanttgggcccttgggancccaatttnacccaattttttaanccccccaatttgggaaatttaaaaagggttnccaaaggaaaaaatttancctttggggggaaangggggcccaaaaaaaaaaaagggaaaaaaggaacccttcctttgggtttanggnttncctttttcccccaagggggggaaggggggggggggggggaaaaaaaatttgggttccaacccaagggaacccanggggggaatcccaagggggaagggttccaatttgggaattgggaaccccttccaaggcccaaggcccaccttttctttgggggaaaaggccccaaaaacccaaattggaaggggccaaggtttttttcttttcaaaaaggggtattgaaaaagaaaaaaataaattacttggatgccagccttttcttttttaaccaaacaatgaatgaagtgtgaagatggaatcaagataagttcagaaatgcatgactttaatacatgctaatagtggagatggtgcttaaactaaaaacagaagtcatgtgatccaggacgcacaatcctctggctgatggtagaatttgatctgaaataggagacatgctgtgaaaccagtctaggatggaacagatcaggagggttctggtgagagtcttcttcaagaagatgatccgcagaatacccatttgaatgtggtaaaaggagttataaacagctgagagaataaatctaactcaggggaaatagaagtggtaatgtatgataaggtcactctgaatatgatatatataatcatgttatgtaacattgaatattgatctacccaaattatagtgatcttgagaaaagaatagagattctacagagttaatttctcttctttggggaagtctcngatactctaaaccaaaatcatgatatgtngacctgtcagaatatgccaaagatactaatgntgagtgtgcatggaatactg

SEQ ID NO: 3881 - DNA, 820 bp, Homo sapiens
  misc_feature (1)...(820): n = A,T,C or G
tgtccctaaaacttaagttaataaaaaataataaataaataaaaataaaaaaataaaaacacattntaaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacataccatgtgattctacttctgtgaagtcaagaacagacaaaactgaaatactcatgtaaggatgcacactaaggtagtaaaactataaagcagagcaagagagttattactataaaagctctgtcgagggacaggagttgcaattaggaatatacagggaattctgtggtgctgagaggatttgttgatctgggtgatggttacccangtgtttattcactttgcaaatgattaagttgtatatatgttttacttaagtggtatatttcatagttttaaaaggtttaaaaaatntagagaatacagcctgggcatggtggctaacacctgtaatcccacactttggaaggccaagacaggaggccgagttcaggagttcaagaaccgnctgggcaacatggcaaaaccctcatcttntgcaaaaatttttttaaaaaatttaaccccggcctggggggcatgtgcttttgnatagtncccagnccccttgggaagcttaaggtngggaggatnacctttaacccccggaggccaaaggttgcantggatcccccaatggatgccncttct

SEQ ID NO: 3882 - DNA, 833 bp, Homo sapiens
  misc_feature (1)...(833): n = A,T,C or G
catttatatgagcaaaccaagttttacataacatgcttttggtatgtattatgactttttacatttctacttggatttcctcttcagatctcagtttccacaaatctgcatccaggttcagggcctctgattctgcacaaatcatatgagccaagtggattgattactagacagatcagatccttccccagctaataactctgccttctgattccagtcctcaaaataaattgcagcctgccattttctttatgttttataagggaggagtgaccaccttttgtcagtttgcttagtttcctattctttgggctcatctcccatcttttttgggtagtcttgctaggagtggttgggaactctgaagccccattttcccaagttgctgagagctatcagacttttagctgcaggctaagagctctgttgcaggcctagtgattggcattaaaagtagggccangaaatctgtcctcatcctcaaatgagaccaacagatatgtattaaagtggagctggagtttgtccttccacccgagactaccaagggcctttgatgcttaatgggaatgtgtgtctaacttgctcttctgacatttagcccgatgaaaataaaatattntatctgtttaagtcntttccnaanaaaaananncaatnttntnnnngncnnggngaanggagnnnnngggtntnnnttnctannncnngnnnnncnnncnannccnnnnggcnccccgnnncannnntnnnnttgnntttaaanaagncnccnattggnttnnnnnannnnnnnnngggnnanannnnnncccccnggccnnttngggnan

SEQ ID NO: 3883 - DNA, 863 bp, Homo sapiens
  misc_feature (1)...(863): n = A,T,C or G
ggacctggctgcctgctctgacaggtacctgtcatctgcccaccatgggcttctgggacctgctgtagcccctgccacccactgctgcagacccacccactctcagcttagctcaaaagctgttctctaactcattnctgacnaatagctgnangngttnccatgantngcnnttnatncaactctggnaaagagggatttaatttnanngncnctttttnacangatnnaatatgttnngcnttatggggnnnnntttcacantggttttgaanagacanaagctagantncatcntaanacccagatnnanatgnggnnatttgcagagctngtnnccgaatatcgggtgccgtcaactgattangattacanttgttacngtgcagccttggnatatnggccannttttaatntngccaaccnatatacnttgncaaagccnttngtccgggntattaacttgggnancncngcannagnnacngnttnncatggantntgggcaaagcgngacttngtttnaatannccaangganataatggnnaattttaaangannntccctttngtgananaantccaaggctccattgttctgcccngttttttncnatttngtatcccaaaatgttgtgnanncttttaanaaaccaantggggaaattngaacccncttttccanctcttggtgaatattnttnnantggtttaaaatcccanttcctaaatcnnaaatancccctggggggnatncngaaaaagggcgntttgaaaaaaaanngaaaanaagggggnacaatagtttgaaagggnngttttttcnanttnaatttggaaaggtnntnntanggcaacccct

SEQ ID NO: 3884 - DNA, 904 bp, Homo sapiens
  misc_feature (1)...(904): n = A,T,C or G
taggncgtttgtatncaaatggtggtaggcccggcctatccactgncacaaagcgggcaatggcccctcaagaaccaagatgatatcaccctccatcaagacagctcggaaaagtaaaagggcatcaggggctggaggataaaatgattatgataacccantggtggatgtttgnttatatcaagtcaacccagtattaaaggcctgcctgatatacaaccctcgaatgcaacacagtgtccttctgaggccactctaaaggccangaaaggtttgctaagaagtctgtgctgttaaaacagaagaaaaagaccttatccattntctgtgctggtggtatagggtagattcataaaaaagaaggcaaaatatttcaaaatgatcaagaaatntgcaagatgcaagacagagtctcaagacagtgccaggacaggatagcactcataacatataacactgtgtantgctgttgagtgctggctgttgttgagtgctanctattggttgagtgctttgttgttgagtgctaacttgcttgagtgctanctgttggtgantggcttggttggttgantgctaactggtggttgaatgccttggttggttgaatgcctaacctggttggttgantggaattggttggttgaagttgccttaaccttggttgggttggaatggcctaanccttggttgggttggaaangcctttggtttggtttgnaaatnggccttaanccttggtttggtttggaaatggcctttggtccccttggcccctngggggccccctgggttttttttaaagcccccttttgggatgggtacccaantttttccttncccantttttaaacccttttcccccccaaaataaaacccccccttatnttaanggggcccggcn

SEQ ID NO: 3885 - DNA, 911 bp, Homo sapiens
  misc_feature (1)...(911): n = A,T,C or G
atatccacgtctcagtcggtggatgggtaatgggatgcccgcttcccctactccagatgattgatgaagaaatggaggtgtatggagatgaggtgacttgcccaggatcagagctttaagtgacagaggcaatattggaactgaggtttccctcattcaaaagccagtggtgcttgtttgcactgccacactggagcagactaactgagaccgctcttgatgggtccttttctacgagaggctttgcctgccacctgccagcatcaggtgatcagaagatgtggtatgaagaccattcagcccgggcgcagtggctcatgcctgtaatcctagcactttgggaggccagggcgggtggatcacgaggtcaggagatcgagaccatcctggctaacacggtgaaaccctgtcttctatttaaaaaaaaaaacaaaaaaccaaatactcagggaaatagcccttcagnttncttcacccacttcagaaaaaatagggaaaaggaaaagaacagggattgggaaaaaggaaaaaaagnaaaaangggangggatccgcttttaagcccttanggaggtttttaaagaattaagttcttgggggccaaatantaagtnggaggaancccctgggccttctttanttttaaaaaaannnnnnnnnnnnnnnnnnnnnnnnnnncctttcgaagcccctttttaaaaaactttttaggggggggtccgtantttaccgtnngaattccccgnaccttggntaaggatnccnttggttgaagtttnggaccaanccccaacttgaatgccgtggaaaaaaaatcnttatttgngnaaattgggagctnttgcttttttgnaacctttttagntgcattaacaagttaccaccaccattgcttcntttntgttaggtcg

SEQ ID NO: 3886 - DNA, 819 bp, Homo sapiens
  misc_feature (1)...(819): n = A,T,C or G
tcacctctctccccaagaaaaacatgtnaaatgcnagactgtgtgctcttaatgacatctatattaagggatctgaantntccatcataaatgaacatggtacttaccaaatatcttctgataantcattcagtgctcaggntctatgtttnttctcctgtccaagagtgaacaaactacacatnaccaaaatattgtaaggctaagnaataataacggtgactgnnaaaatgggaaatgagatagcgtcaaacgtttgtgacaaataaaagcagtcacngtaaacactggnctttncanccccatnaatgatgactttgtncccaacttgnattcccaacngcatcncaaanagtaaaangagtcacatggganataaaacatcatttttatcacaagcttataacgggtnatttttttctgactntgngttggagggtaanngggcttgctnatattgcatgcagcanngaacttacccgncatatggatgcctccctctatgctagtggtcctcncctttatggcccanggatcanantcatggaaagacaggtatccctgngggaaggtttngggatgaaantggttcaccttaaatcatcaggcattaaaattctcataaggcatgtgcaanctaaatctnttnacatgtgcagttnacaaggaanggggtggcacttcctctgaaaaatctaatgcctccctggtctgccaggaaggtacaacttggnttgggaangnttgnnttggtcncnggtccacatcctggtgngccggngnggntncccanaaggccnccggctggtnncnaattan

SEQ ID NO: 3887 - DNA, 771 bp, Homo sapiens
  misc_feature (1)...(771): n = A,T,C or G
gaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgnaaatttttatgtaaacagaangtcttcaataagtaaagtaactccatatggagtgattgtttcagtccaggcaatttttctattttatattaagacttcatacatttatatatgtaaatatggcttattaatggaatgttaaataaaatgtatacttcaaaaaaaaaaaaaaaaaaaaaaactcgagcctntaaaactatagtgagtcgttttccgtagatccaactgataagatacattgatgagtttggacaaccacactngaatgcagtgaaaaaaagcttatttngaattgtgatgctatgcttattggaccatttagctgcataaacagttacacacatgcttcnttatgtcagtcaggggngggggaggttttatccgcc

SEQ ID NO: 3888 - DNA, 1232 bp, Homo sapiens
  misc_feature (1)...(1232): n = A,T,C or G
gatttgaattcnatacanctacttgttctttttgcaggatcccatcgattcgcccagggaatgctggcttcctcctattgctattccttgcctttcctaatgccttgaatcagtgcattcattcattngttcatttcaatcangaaatatctgtttagcacaaacatatgatatttatttatctaaagtgggaaaaagaaatattnggnatntcttcaagtggtntgggtnncctggcttccctggaggaatttttaaaaaaccgatnnccaaaccattttttttttccaccnagnccaagggttttgggnttggcattattggttattncaaaaaaagggttcnccttaaaaaggaaccaccaaccccctttttttaaccccccggttccaaaattttcctttacnaagggtccggaangtnccaatttnttttttccttnaaaaaaaanaaaaanaaaaaagggaaaattgggtgggttttaaccanaccaaattggtttttaagtaaaaaaaattttttttaancccccancccaaaaaagngttgggttggncccanttccccccanaaanggggggggnanattttttttnnaaaaantttttttttnnnnnnnnnnggggggggggggggcaaaaaaaaattttgggggaaaaaaaccaangggggccanaaaaatggggttccnttnaaaaattttaanccccngggggggggggaaaccccccaatttggaaaatttantttccaaaacgttcaaaaaaaaatttaaaattggngggtnaaattaaacccttttttnggggaaatnggggggccntttaaaaaaaattaaaccctttaaacccttngggnggaatttcccaanttttaaaaaattanccccaattttnggggnaaaatttgggggnaanttttgggaacccttaanttttttttntttttgggaanccatttgggcccgnaaaaaaaaaataatttttcccaaaaaaaaccaanttaaccaagggcttttttttaaaaaaaaaaattggggggccnttnttggaaaaaaccaaantnggttgggctancccngggttggcccacccanccccaaangggggnccccttngggggggttttttttcttnaaaangggnaaaaaatccttttttggagggccaaanccgggggaancccaaaaaanaaagggtnccccnacntttaccaagggnnnaattgtgntt

SEQ ID NO: 3889 - DNA, 835 bp, Homo sapiens
  misc_feature (1)...(835): n = A,T,C or G
gagcctgatgcagcttgtctgtctgatgcttttgttccccatccacgtcccccccagtgctgaagctgtttcgtgtgtccttacagtgtttcctctgcacttccacttgtggttgataagtggcagggggacaataaatagagttgatgaaagatgggcttgggcagcagtgggcccaagtgaggcagaaatgagaaaaggactcctggggcagaggtggagtgacaaagccttgagcacgagggtgtgaaatgtgaacttggtgctgacctctattgggcagccggggcaccacggaggtggatgtggtgtcagtgagaccagtgagtaattttagcagagatactttagggatgacttggggagggcagcangcttttttaaaatatatatacttcccaaaataacattgcttcagagtagtttcctaactgccctgggacaggcctgagatcctgtcccagggtacttggggggcacatcctgtcttagggagaggtattcacctncccattcccatccccagtcctggctgcttttcctaaatgcatcatttatcccccacattgccccattctaacccatatcacctctttagagataccttncccttcattgagggagcatncctnttataaccattaacttccatattctggctgggtttcttttaaaagcacttgtgnaaaatttnggaagtantttaatttggttaaaaccttcattggcctcttttccttccatttaaaaaggngaacctnccttgaaaaacaaggggacccgggggggantctaatantaattcacctcttggattcccttaanccccctaaac

SEQ ID NO: 3890 - DNA, 880 bp, Homo sapiens
  misc_feature (1)...(880): n = A,T,C or G
tgtgatgaaaagtgaagctgataagggtatagtggtgacttagggtgctgatttagagttnggtcagagaaagtctttcttgaggagctgtgtgagggtttgttcctatctaaaggcncagaggagattcaggcccattgaagatgagaaaacnctcctggacnacnttcccactttttttgtaggacactgttttgtnaaaatttacatatatggctaaatagtctgaaactatggnttcantggaancaaccggtatgtgcccatggaagagttttcccaggaaaagaaaataattcattacagntttnctggcnctctgaaaagggaccaggagctgggaactgctgaaggctaagctgctgctatctgtggnctcaaatggagagccgctatgaaaatgctgcttgcaaggggcacattatataattctatggggtgatatccctaattttagaatggaatgaacctaaactcttttctggantatgtttttggatttagccccaaaaaatgcctgggganggngganggacccccttaacttacnagcccatttggcntggttctttggggcatttggccngccagaaganggaaccagcccctttttacctttcatctgaacctgggntggccttttttttttaaaggnnaaatnnnnnngnnanaaannnnnaaaaccttggnnccttttanaactttagnggngtccgtntttncgtaanatnccacacttggataagnntncctttgatggaggtttgggnccaaaccccccccttggnaatgccngtggnaaaaaaaangcctttntttgggggnaaatttggggangccttttggctttattttgggaaccntttnttaggctggccan

SEQ ID NO: 3891 - DNA, 808 bp, Homo sapiens
  misc_feature (1)...(808): n = A,T,C or G
tcatagtctaaaactatcacgtctgagttgccttaggatgacagtgctgacacccagtaggaagtatcccatttttatcaggaaagtcagtcacgcgtagggatggtgaggagacgcgtatggatggtgaggaggggagaggagggagacctgctggtgcccttgcaccagggtgaggcctgactcacgctgcttccccccacaggccctgctntgcttgcctgctttttccagaatcgattttgcaagcttcaagattctgttcccctcttcgcacaagtgaggaaggcaaatactcagggtttgaanggagacctgccggcctgagggctggcaaatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagaaaatggtaggaattgaaactatttgnatatgttgaaatttgtaggggttcangacccatggcagaaacacttaaactatttatttacagtatgactattttttttcaaagtnggcaattcttttgtatattttaaggcaaataatcactttaccttttggtgccttncatgcgtcgcantaagcactcttgtcaatcatggnaattgggaaaaaaagatgtccatttagttaaacaagaaaacactattttgtancatgaatttagaatggggnccttttaa

SEQ ID NO: 3892 - DNA, 814 bp, Homo sapiens
  misc_feature (1)...(814): n = A,T,C or G
gaatgtctttgcttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcatangtgagtaaagggactatataggctgctgttactcttccaaattctgtcctcttccacaattgtcagcgtagtctctcttgcttggaagagatatgctccagtaagagacggaagatagagatttgctgttggattgtttctgggactgaaagactctgggctcacaagtccagggcatttgccccttgccactctgttgatganggagacccaaggtggtctttagtactgcctactacataccctcagttgtcttcacaagcatgtagtgctctgtctcaaaaaaaaaaaaaaaaaaaaactcgagcctctaaactatatgagtcgtattacgtagatccngacatgataagatacattgatgagtttgggacaaaccacaactagaatgcagtggaaaaaaanctttatttgngaaaattggggatgctattgctttatttgtaaccattataagcctgcaataaacaagttaaccaccaccaattgccttcatttttttgtttcangttcagggggganggggngggaggttttttaattccnggccggggggcccatgcatttgggccccg

SEQ ID NO: 3893 - DNA, 825 bp, Homo sapiens
  misc_feature (1)...(825): n = A,T,C or G
taaactttattctttttgttatcgtttgtcctctggtagtgatcagtggtcagtctttgaaaagaaaggacctatgaactcaactttagttacagcaaagaaatgagtaggagacggagggaatggccagcagccattgaagagggagagcaggctgggcccaagggggacccagtattggcagaaaggaaagctcagggtgtcaagtgggcctgagaagggatcatctggctgaacaagagaggtccacatgtagctctcagcacacacttgtgcattccagcttcagcatttgctcacacgagttccccgcctaaaatgcctgacattctccctctctacttaactcatgtaataaatttttactgaatgcctgtaagtgccagctttctgaacagagttggtcacagataaaggtgtgttgtagagtcattaaaatggtcaggtatttgactggatctccagtcggaaaaaaaaaaaaaaaaaactcgagcctntaaactatagtgagtcgtattacctnnatccagacatgataagatcattgatgagtttggcaaaccacaactagaatgcagtgaaaaaaatgctttatttgtgaaatttgggatgctattgctttatttggaaccatttntaagctgcaataaacaagttacaaccaaccaattgcnttcatttttntgtttcaagtttcaggggggangtggtngggaaggtttttttaatttcncgggccgcggcccccaatgccnttgggccccgggaccccacntttttgttccttttantgagggttaattgcccccttggnggtaaacatgg

SEQ ID NO: 3894 - DNA, 836 bp, Homo sapiens
  misc_feature (1)...(836): n = A,T,C or G
gccatcctacattccagtgagggttgctgaaaaaatcctatttgttggagaatctgnccagangtttgagaatcaganngtgaacctgnctntananggatccattttgcaaaaccangaanacactttatgctgcactagctgcaccgtcctcangcagnanccactcttcagctaaggtggactactgaacaggtggcggatcgcattangcagcactgtggctgagcatctntngaancnnatggtggancaancnnnttnactgggtnnncngaagaccatnnnatacnttnacctnttgggaccatganaactgtttccagcccctantgacgcagcgaaacacatgtatgaaaacaccanccactggtagtactgatcatgatgtgaagtgtggcctntctacagttaacngcncggtgtatttgctatgatgatgacaccttcttcctctgttgncttgacgngcgnccntacggcaaggagcgcaatatatgtantcaagcgngagaagggccttcnctgnnaacttntacncgnaagcccctgntatggctgggnngccctaagtctttnctacaangtacaggaggccccttcataaaactcttcaccccacatggncctgnaaaagnacaaagtggntgttaagnctctaacttgatgtgcgnccgggngcannctgagcttgcaggacttgctgggccttnaaaangccngggcnaggaanttnaagctngaannanaaatgangccaatcnanttgggnccnaanccaaatcanctggggtttttgggngganaaaatcccnggactntttnccggggttttn

SEQ ID NO: 3895 - DNA, 767 bp, Homo sapiens
  misc_feature (1)...(767): n = A,T,C or G
tgaagacactgaccttgtcccgctacatctgcgagatgaccctgcaggaataccactatgtccaggagaaggcttccaagctagctgctgcctccttactcctggccctctacatgaagaactcggatactgggttcccttcctggacattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgntcgaatttgcttttgatcgcttttattcatttttcctttctttgncttttcccaaactgataatgntataaatatttatgttgcttggttttatgaaagaaaaaatattgncatatttgactacaaatttaataaaaaaattaatgggtattggtaaaaaaaaaaaaaaaaaaaaactcgagcctctaaactatagtgagtcgattcgtagatcngacatgataganacatgatgagttngacaaccncactagaagccggnaaaaaagcttattgggaaattgggatgctatgcttattgnaccatttaactgcataacaatacacacatgctctttttgttaggtcngggngg

SEQ ID NO: 3896 - DNA, 961 bp, Homo sapiens
  misc_feature (1)...(961): n = A,T,C or G
ggagatgaaggttggcagcanctggtcatgaangtgttaacaaggggccttcactgggctgngcgganctnctgaagatgtttgcncaagagaagggttnggcctggtacacatnaaaactcctgggacctcggaggtgatcgagcctaaccnggggccatnntacagatatgaagactgagatgaagacaggagaagggncatgctgngaagtccatanactgggcctggctcctggggtaaactaatgggnacaaanntctgangattcctgcntanaccacnaaatggacagggncaaggcccntgatggtnagcccatgcctgacactgacnanttnacagnccaagaacacagngatgaagaataaaaagtggtacaatcggnttcacttgtgccaccaggatactttcaatgattgcnttcctgtnccacaaanttcttttantcttgggcggcgacncaantganggannggggaacttatncatggacgccccctttttcttcgantggganggaccacttgaaaacttcatggaaaggcccanaggtttacattggccccccattgnaccttgagcccnaagcttgggnaatccaggaaccttngggaaatttggggccnccttggnggggcttgacccccccataanaaggttccaagntgggcccccntgccttangggatnaaagcccgttttaaaccaacaatttanggggttaaagggttggccctttttcatngccccccccnttnaagngtaaaaanaaangggggnacccttntanaaaccnccatngggaaaaaaaaaactgnggggccttggggnccccctttggggaatgncnccagnagaaatncccnaggggccttnaaaacctttttcctnggggccaataancctnaaantttgctttnttttaaaaaaanattccntggaacannggggggaaaan

SEQ ID NO: 3897 - DNA, 832 bp, Homo sapiens
  misc_feature (1)...(832): n = A,T,C or G
gtttgcangctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatnctgttggcgccggccaccgcanagctggagcccttggctgatggacaggtgtcccagaccgacgaggaagatatggggatgacatatgcggagctctcggtctatgggaaactcangaaggtggccaagatggggccctacagcatgttctgcaaactcctcggcatgtggagacacatcttgcaccccgagacangtcgcttgacaaagtgaagcggtttttctccaagtacttccatgaacagacacaagatgaccacgctnacacccgcgtaccacgccgagaactacagcccttgaggacaacaggtttgatcttgngaccattttntgtcaacacaaagctggccttggcaagtttcggtgcatanaaaaatnaagtgctacaagcttcgagccctntanaactatagtgagtcgtnttacgtngatccncacnttgataagaatncatttgttgagtttnggncaaaccnccacttggaatgccgtggaaaaaaagcttttnttttgtgaaaattggggaaggctnt

SEQ ID NO: 3898 - DNA, 821 bp, Homo sapiens
  misc_feature (1)...(821): n = A,T,C or G
cttaatgttatcactcattgaaaagtttcttttaaaattatatatatggcccaatcttgaactatcttattttggaaggttttatctatttttaatttatgtcctcccgcctttctcatacccagctccacaagaaaatacagatctgcagaaaatgatttgaatgcctactttctcactcgtccaaggatgatgctgcatagctagtaccactctagatgcttggaagaaaagttaattcaatcaacagatagtgcattagagtttaattcttttatagaactccatttgagaggggctcttaaaaattaagagcatgcataccaaagtataataaaaaaaattaagaacaaagatgtaatggcttactgcatgagatagaaaacacccatatattgaaaattgagtctttagggctagtttttattttattttatatatatatatatatatatatatatattttttttttttgagacagagtctcactctgtttcccagactggagtgcaatggcatgatctcggctcacggcagcctctgcctnctggcttcaatcagttctcatgcctgtagtcccactgctcangaggctgaggtgggaggatcacctgaatgagccttgggangncaangctgcaatgaaccatgaacacaccactggactntaacctgggcaaaaanantgagaaacccgtttcaaaaaagaaaaaaaatctggaataacctattgggccttttggttaattnnnaaangnnnnnnnnnnnnnnnnncnnanngnnnnnnnnnngnnaaaannnnnnnnnnaanaaaaaaccnn

SEQ ID NO: 3899 - DNA, 881 bp, Homo sapiens
  misc_feature (1)...(881): n = A,T,C or G
agttttaacttgaaccccttcagtcaggatgaacataaagctctcaagttcttgaaaggatgagacacaagaataagatggggtaccagtgaccagctcctctacctggggtcatggaggaccgaagaccctccaaccttgatgcctgtaaggacaggcgctcctgtaagggatcaggtgtaaagaatctggccatagctcctgtacaaagcctctttgtctgaagtacttgggtgctctttgacggcaggagggaacacaacctgtcggtggctgctggacctcaccacgggggctcagtggacataagatctattgacaggccctggcagtcaccantgggtgtgtgtggcantggctgtggggtgtgagaatgactgcaacaggcacttctcaacaatgacctgctgttcacatgggccctgagcanggaggaagggagagggacaatggaagctttgttccagcattcctcttanaaaggggagagacaatttcangcaggtgtnatggaattggaataaaagcaggangctcaangggtgggtttcttgagtaaaaggacaaaaatcgtgggtgcttttgtnggttcaaccacaaccctttcattgggccagacaccccacattttttttccctactggncttccattttttgccccctttttttncttaccttgccttnccaaaaaaataagaatgcttgctttattaaacccattttggggggcttgcttcttttgggtcaaggaaggggtgnttgcaaaaaatnccttccncccangggattnaaatgaaatngggttgttcccccctggagccttnttaacaacctttttaacccaggtgttcaaaaaaatttntttccccccncccnccnt

SEQ ID NO: 3900 - DNA, 812 bp, Homo sapiens
  misc_feature (1)...(812): n = A,T,C or G
ctctgcagtctcttaagcagattgactatgatgcatgtcacataaaacagttttctttctgttctattgtggagtttttctggggctggagaacattcttttgttatttccaaacactgtctataattaccanacatgatataaacacataaggtgccaactggaatttactctagaggggactttccctctcagacttccagtcaactcacacttgtgcaacaaagtgcatgctgtcccctaaatatgcaagcagaactgtgtttctgcctatttggtatctatagtcctctacagtcacttctanagagactaaaccaaatttctaccaacttcacagggcaacaatcaatagttttatctcaatgactcttgtatcttcagaccttaaactgattcanagaccatggggcccacaaacctaatcagagtaacgttttcattgagtacacattcanacatgagaatcttcactttncccttttttctcttggtaaaatgttcacaaatgtgcaggtaacacctgctgctactccagccattcnggccctaaatctgcagctctacattttgtatctaggtcttgagaattgggaaatagaaaatttttatctaaaaatgcaggtccttttggttatcaaactcagacattgaaatgaaagtgcagntacccctttctcctcctttgnaatatgnattcatctcttggaaactggtcactattggccncaagtagatgtatattnaactggttatanccacattggacactggttttcataccctnaaccctaaaggaatatggcccaaca

SEQ ID NO: 3901 - DNA, 815 bp, Homo sapiens
  misc_feature (1)...(815): n = A,T,C or G
actttatatggattctctaattttaatcttcaaaatgctatctaatgtctcattaagacttgcatataatgtatcttaagtacagtcattaaatatagtttagggagatttatgttcagatattgcttaaagatgttttaataggcccatttactctgatgatattaatgagctcttaatacagactaagcttctaaaactagtggtaaagactcccagcctgaacacaacaacttggaattaatgcctgntttggacagatgcctgagggtgagtcctgcacacactcgagggtcancgcgagccccttgctggatggagccttgtttcanaaaggggcctcctgtaacgggctctggctgctgactccagagcacccattcttcggccagcctgagtactgtcttttttctcccccaaactgtgcacaggacatgtgctaactaggccgaagtacctctccaaggttatttgagaagcgctgatagccttggcggtggcactgnggcctgtgaggggttaaaggangctgttgctgaaattncgtggaagcatctgccaagtaaggtgtgcacagactggcatcgttacntgaaacaagcntncctntgncaccaagtgaactgnaaaanggcacatgggtgtgctttcatcttttangcattcatcctancttgaaatacatgtaataaangngncctgcttatttcaacntcggaaccnnaaanaaangcnnnaaaaancctcgancctttaaaacttttntgagttttttttcntaaatccaaacttgataagaaacattngtggagttn

SEQ ID NO: 3902 - DNA, 820 bp, Homo sapiens
  misc_feature (1)...(820): n = A,T,C or G
ccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagatccattactcctcacaggtatttgtgaagtgtcattttgattatnatccatacaatggccacctaatccttgcaaagaagcaggattgnagttttncaaaaggagagatcttcanattgtaaaatagagaagatnccaaatgggnggcaggcttncccatgttaaaaaaagganggaaaccnctggtcttcnttncaagccaattnctgggaanaaaaaaaaaanggcttttgttaaaanaaactggggacaattcaaggancctttttgggggactntaagttgccaaaaaaaaaaaaaaaaaaactcggnccttttaaactntng

SEQ ID NO: 3903 - DNA, 726 bp, Homo sapiens
  misc_feature (1)...(726): n = A,T,C or G
tnnaanctaatgcttggctacttgttctttttgcaggatcccatcgattcggtgagccactgcgcccggccaaagacactttcaaatactcatgattggatatgcctctgtgattgacagtgagatttcaaatgggttaaagattgctctgcaaagaggttaactgttgagattgatacaggctatcttcaacatatgtacattgctgtatatgacatttacctaccattgtgcatctgggacttcctgatggaccacaggaattcccttttcttcccattctcttccagatctttcttctacttgaaaccccttatctacaaaaatgaataaacaacccaatctcatttctgatcgtgtcctggaattgatctagggcaaggtctggagaagtggtgggagacagcagacagcttttgttagtcttctaaccccagcactttctcagcctcatctgtgtgttcctgtctcactctgcagacctcacttcacaatgctcttcagatcctttaatgaataggaaattgattttgggtatttctataaaatacagcaaagtcttagaaacttgcagtgtccttaagaagaaagatcccttcttatctccctgccagtttttctttctttatggctcaaacactaactgattttgccatggaggtattgngcttcanactgcttttggtgaactgggttgaggacataacccgttgtctggtatatttt

SEQ ID NO: 3904 - DNA, 797 bp, Homo sapiens
  misc_feature (1)...(797): n = A,T,C or G
nnancntgctacttgttctttttgcaggatccctcgattcgaattcggcacgagggaacatgcaaagcagtagccctctgaggagcagagttaaggctagtacagaaaagacttttcctcccaaaacaccttcagtgtttggagaggctattatgtcaataagtaaagaacatgctactgtgaaaaaggtacaggaacaaaaaagagttgccaaaaataaaaaatattattgtaaggtaaaaaatttcataaatgggcctaatagtgggatggatataactgaaaactaagatggtgatgaggaagacagtcaagaataaatataccaaagtagcaaagaaatacctgtgcaagtagaatagcttgcttcaaacagatgagatttgtcctcccaacatcaaaacatatcacaaaactacagtaattaagtccctttgaggccagcactgactgggataagcaaatagataaatgggatgtaacaggccttatttcaaactaataggttgttcaccaactcctagttggataccctgctatccattatgaaaaagaaaaaaaggtaagttctcatcttacaccatacttaaatttcagatgaattaagtattaaacataaaaattaaatgaaacatgggtttncctggggattctaagcctactccaacttggaagctgcaaagttggctttgtgntctacatgggaaaaaaaatagaactgcaaaggagaatatttactattgactacttaaacttaaaatactacatgacangnnctgtaaaatagttaaagatat

SEQ ID NO: 3905 - DNA, 756 bp, Homo sapiens
  misc_feature (1)...(756): n = A,T,C or G
gtgnnnnnnttgaatctttgctactaanngcttggcnactngttctttntncaggnagcccatgcgattcgaattcggcacgaggggaaggtctggctccagcttgagcccactcacaggatgtcagggggaagtgtgactaaggtcacggccacgccacgtggtgggccagctggatccagagcaggggccgttgtggccacacatcctgagtttccatggtctaatgcagtgggcttgaaaaaaaagggtggatgcaggatgctggctgggactgtggagtgcgtgggcagtaagtcttaagtgacagtgggtggagattacagcatttcatctgcttttcctttgacaccttttaaagatacaacccacagttttcaagggtttatgccaatgtctgctagagggatcttgcagtagatcttaaaccctatagtattcttaagagcacaaggaaattcttatttgggttccatttacaacaaaggtggaaatttaaaactaggctgagaatttgaaatgctgttcacattaagcagtttattagggggttattttgaaatcgttctttaagtaattttaagatgtttccacatctcaaaaggatncatacatttttcttcatttttctttggagaatgtctgttcaaggatgtttaccaggtttgggttttcaaaatttcagcggcttttatngngctggcattccattcgacagattggaatttgccccttanaggaaatgggaatgttttt

SEQ ID NO: 3906 - DNA, 755 bp, Homo sapiens
  misc_feature (1)...(755): n = A,T,C or G
agagnnnnnttnnntcttanctactaangcttggctacttgttctttttgcaggatcccatngattcgctgtgaagacctggaaacagncaaaaaagacttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtntntgtttacttttactncatgggcattgaaaaggttaagaaacataaatggtcatatttttaaaggtaagtacatgcatatatatatgcacacacacctntttttcagcatttttttgaaaaagtcttggggtctcaaacacatttgnctcaaccacattttncnaaatgtgattcttaatacctcaatnttggcttganaaaagtgccngg

SEQ ID NO: 3907 - DNA, 738 bp, Homo sapiens
  misc_feature (1)...(738): n = A,T,C or G
agagnnnnnnttntatcttatgcctaatngcttggctacttgttctttttgcaggnatcccatcgattcgaattcggcacgaggccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaagctttctggcagctgcctgggtttggccagaccctgcctcccctcccgccggccaacccctagtccccttcctgtctccacttgcattcaggggtggctgctgttctgagaacattagaactgggaagagagatgggagtcacatggatttttggtgggcattattctgaactttcgtatccaagttagtcccccttattccactgtgggcattgcccgtctaagcagttacctgatgcctgctgctgaaanctgctcacaggangcggcggcggccctggcactgnccttgcattagncttgngtttgatgtgttcttgngaattactttgtcagacaaaatattacccgttgggtcangaattcttttactccc

SEQ ID NO: 3908 - DNA, 731 bp, Homo sapiens
  misc_feature (1)...(731): n = A,T,C or G
agtttnnctatgaacncttggganctcaanngcttggctacttgttctttttgcaggcatcccatcgcttcgaattcggcacgaggttttntgttataggtaacaggaaaacaaactaatncaagtggtaatgtgtccagctaaaaatttgggttctgttaaggttaaaagaaaatttgaggtanccagcagtatctgcctcagatgctganaagcctcctgagataagagcgtataccatgtccataactgaagttttaacattctntgccaaacagaaccagaatttaagggcaggagaatttgcaagatagaatttgcaatttgcaagagggaattgcaattctgcaagagaggggcaatttgcaatttgcacagagagggcaatttgcaagagagaattgtggggccctnagagagaatacatccanaggaagagggaaccangcnttacaaattgaatngaacaaggacagatatctgaagggggtttggtagttcccantcaagtatggtacanctangtgcacttccctggccagaccaccctacagtgtatgatccccctggggagcaaaagctgcaagtaacacttttggtgccctataaattctgctgtggngccactatacngatcacagccaantgggcattgtncccttttacacaggatctgggcatncacnccangattgcacatctggcacgantgtgtctggacaggaagacct

SEQ ID NO: 3909 - DNA, 747 bp, Homo sapiens
  misc_feature (1)...(747): n = A,T,C or G
ttctttgaaacctnanggcttgggcnactcgttctttntccaggnagcccatgcgnttcgaattcggcacgagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccantattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagatnaatatcattttagctataacctaaaaaagtgttaaataaaatgacagatgttaatttaaaagcagccatatgctaatttactttttcatatgatgatggtctaatgggaagttccatatgctttcttttgggcctaactctgaaaaaggtntatgtcagaagttctnggaaatatgtctttagccaaggaattttattccccttaaaatttggntacc

SEQ ID NO: 3910 - DNA, 748 bp, Homo sapiens
  misc_feature (1)...(748): n = A,T,C or G
caanctaanggcttgggctacttgttctttttgcaggnancccatgcgattcgaattcggcacgaggctcattccagctggtctatcgtgggcctcanaaggtgaagagggaccgtattctggggcccacnatagaccagctgtagctnattncancctgtaccttggttgatgggtaacctacnactgcatcccatnctgaatatnctttgaaactccncannagtgcttatttaagtgtaaannctcctnagagnactgcnncnnnnnatngtgnatctnnccctgnccntnganngctnnangngcnccactactncaanccanaaagaaaagngtgctgntcataangccncantacggatctganntcatnaggatnacattnnccnaaagggagtnaantgnnggnaantgcntgncactatatgaantacacnncantctgtnantcacttttaatnanntactganccctttctaactatcaggcgtnttattncatgaatcccnccntggtaagatacatttntgaactngntcaaangcnaacttcaatgcngtgananaaatgctctatntngggaacnttggngannctntngctatattngaaacgnntntnaccttgggactggccaagtnaacancnttcaattaccnttaaantntantgtttaaaggntncaanggnnaggtcntgtgnccntnattaaatntaanaagnngnccatatccngttnattcg

SEQ ID NO: 3911 - DNA, 719 bp, Homo sapiens
  misc_feature (1)...(719): n = A,T,C or G
aacntaangcttggctacttgttctttttgcaggagcccatcgattcgaattcggcacgagcaccccttttaggatttacattagttctgttccagtaaaggcttaggtaggaagcacaggatgtagagctgagttgaacctattcccctgatcttactaatgaggtgcctgatattcagagagaccaagggacatccccaaagtcaaccagcaatccattagagctgagcctagtaccttgattctcagacatgaatgctacttgttgaattgaaaattgcattcataatacatctcttcatagattcctggccaggaagccccagagaccaaaacagtggttatcaatatttagaatatatcagatttacctggggagctttatcaaaatccacactcctaagcccaatagggggaaactctgatgtggtaggtttagggtaagacctgagtatttccaagaaaacctccctggatgatcctgacacagggagctttcagatcatcctttgagaaaatctgctttagagctcattctttggttcggctntctcttttgagctcactgatatcatccctgtggacactgaacttttctggaagctttctcatctcaggaattggtttgggttactctacaatcagatttccatncaggatgtcacggcagtggctcaatactgcacctgtgtccttctcagccnaactggnctgggcc

SEQ ID NO: 3912 - DNA, 755 bp, Homo sapiens
  misc_feature (1)...(755): n = A,T,C or G
ngggnnnnnncnntttcntctngctganacccccngtggnttgnccnactcgttctttttgcaggcagcccagcgtttcgaattcggcacgaggaaactgtttaanttttaaaggggtgtattggtgtatgtcactgaaaattccacaggtacagtgggcttcaggcatggtttgattgggatgccagctccgttttgctgagattccattggttctgctttctaccgtgtttcagcccggtttaggtggcaaaacagnggtggaaatgttaggcttcacatcaccgtaccacatagaccaaaatgagagctaatatccaggatgagaatgaacagctcttctaatcaggctgtcataaaaataaggaagcttattttatagaagcctttaccaaacctccttctttgacttgntgntccaaattggattaaccagcccattcctgcggccaaggaaatacacactggttaacccagtctttactaacccatacctttagcaaagagattggattacccaacaacttgattgctctggagactactttggagttggggtatgagatagtagataggagaatgatctgtaagtagatattggataagcgagtaagaaatgcaaactacactgaggtcttgcactggtctaggttttgggacccagatgtaataggacatagntcttttctcgagcctctagaactatagtgagtcgtattacgtagaaccagacatgataagatncattgatgagt

SEQ ID NO: 3913 - DNA, 739 bp, Homo sapiens
  misc_feature (1)...(739): n = A,T,C or G
ntttgnaanctnaanggcttggcnactcgttctttatncangnagcccatgcgnttcgaattcggcacgagcaaacccctcctttgtactcgcccttcataatcacttttgcttcacacacataacctctgacagccactgatgtgttctttatgactatagttttaactctggaagaatgtcatgtaaatggggctctgtgttttgcagcatcatgcagctgtaacctttgattcagcagataacaatgtgcatggcctctccactcaaggtaatgcctttcagattcattcaagtggccgcatctatcggtagttctttccttttcattgctgagcagtattccatcacaagggtgtaccacagtttgttcgtgcactcatcaaaggacatttaggttgcttctagtntttggtaattatgaatagagctgcttaaaaacagtgtacacatgtttttataggaacataagttntcagttctttagggtaaatgccaacaaatgaaattgctaggctatatgttaagtatatgcctgactatgaaaaactgcccaccattttccagtgcggctgatcactctgcattctcatcagcagtgaacaagggttctagttgctccctaccctnttcagaatgtggnattgncagaattttaagtttancccagtcttaagaagtttngtattgntatcatatcatgggtttaaatttggnanttccctgaccggataatggn

SEQ ID NO: 3914 - DNA, 749 bp, Homo sapiens
  misc_feature (1)...(749): n = A,T,C or G
agggnnnntnnnttcntctnatgaactcntanggctgggcaactngttctttctncaggnagcccagcgtttcgcgtacaaacaccccaanncaagctttttcatctgctgcntataatcacgagtcctatncttctgcactatcangngtnttntactncctgctnaanncnntgttgtccatttnattaagacagaagttnctnttattgtnaaatttgaactgtatctatgttataatagtaatggtaactcantccaaaggacctantnacaggaagtaacntgtcntacatatcagtnnatatanggnnntnagtagggacatactgtgatcttggnatacttgnaattttttannttcctgggcggttcantgcattgatnnatcacatnatnntaanacatgtatgttgagacanagcangantctgtctcaaaaaaagggaaaaattcctggactacataaattaaaagtccatgaataggattggcttctagcatgccccttcnggtgctcagacacttaatcagaaattggacttgangttanttttattctcaggccaaccttctccagtantgatgaananggccacncagcaactntgacctgccantntggcaaaaatggatcanaaaagtgtaanctaagctgcatcngaangcccangaatgcctctnactggcctgacttncgtcatgngcccatctttgcacaacctgtggnctttggcanggcaagggnn

SEQ ID NO: 3915 - DNA, 734 bp, Homo sapiens
  misc_feature (1)...(734): n = A,T,C or G
tctttgnaancttaatggcttggctnctngttctttntncaggntcccatgcgattcgaattcggcacgaggagtatgtgtccagcgccccctgtggtgtgtgagagaaagcagctgcaactcaagtgactaggtgggcccagctggcttcgtgcaggagggcacgtcactgcatacgacccggccaccgtgttctgaaggacagcgccaaagatgggttagagtcactgctgtgggagtcttcgtccccacacagaggacaggctgctcagctccactgtgcaagatgatgcacacccagaccagtgacgtcaggacgatgctgctcacgacagcaatggtgaagatgcctaccgtggtcccatccttcctgcagcctgctgcgggcaggacgctcagctggctgtgagctcgctccgtgcccagggtgttggacatctcacagataccacacggtcttccaaggggaccaccaaggatggggtctctacaagagagcaacagagatcttagtcattctcagggcctccgttgctctggctctgccggtcttctggacaacggacaatccaacatatcaatgagatgcatctgagattctgtctcanagtggcaagctttggagaagacccttcaactcattgactgagtcatctccatgctgggagtggcttccacagggacagtgaacctctgctgacaaaagcccctgctattccttaactgtcctgggc

SEQ ID NO: 3916 - DNA, 743 bp, Homo sapiens
  misc_feature (1)...(743): n = A,T,C or G
agagnnnnnnttnatcttatcgcctaatgcttggctacttgttctttttgcaggatcccatcgattcgaattcggcacgaggtgatctgcccgtctcagcctcccagangagcacgtggattacaggcatgagccaccatgcccggccctggatgtattntctatcctagaatgtccacctttaaaaatgaagcccagtgaaaagtgttcccccactaaaatgtggactgttttgcttgcagggatgtgtgggtttctggtagatagaaggctagagctagcaccttcccaaattgcagaggaatcaatcctggcttgtctgtgagctggggaggaatggaaaggtaggggccttgagagtccttaattacatagggaatgtcctatcattttgtntattctttaaaaagataatgggattcttttntgntgttgttagtctcgctttgtcacgcaggctggggtgcaatggtgtgatctcggctcactgcatcctctgnttcctgggttcaagcaattctcctgcctcagcctctcaagtagctaagattacaggcatgcaccaacatgcccactaatntttgtactnttagtaaagacngggttttgccatngttggccaagcttggtctcaaactcctgacctcagatgatccaccctntttgggaaccaaggcaggaagattgctggcagccaagaattcnanggtgcaatgagctatgattacatcactgngcttcaa

SEQ ID NO: 3917 - DNA, 733 bp, Homo sapiens
  misc_feature (1)...(733): n = A,T,C or G
ttnttnnnanctaanggcttggctacttgttctttttgcaggagcccatgcgattcggaaaaatatagctaacacttaatgtttgaggtctgagcactttacattaaatatttaacctataaaatgaaatgagaacttacttttattatcctcacttatacagatgaggaaaccaagacacccagagattaataatttgcctaaggtaacaaaattagtaagcatcgtaaccaggatttttggtcagtctacacaccttccccgttccctcactatagtgcctgctgcaaattgtactttaagctatagttggacaaaatattaaaatctatctgggatgataggtgaccaaaaaaaaaagtatatttgaaagtatcacagtgttaacagggcagtgaagatgataaggctaagatacagaaaggaaaccagagagcagagtctactgcttgggactgtggctcctccaggcacctttgaccattcccaataaggtaccgtgagaccctgagcactcttcctgtaccacctacacagctctcctcttcctttcctgggtttactttatttttcactatcagcatctgttgcactatattgtcgttatgtcagtatttgtttgttgattacccattctccatggctaggaatgtcagctccagcctgggcaacaagagctaactccatctcaaaaaaggaaaaaaaaaaaaaaaaaaaaactcgggcctttana

SEQ ID NO: 3918 - DNA, 748 bp, Homo sapiens
  misc_feature (1)...(748): n = A,T,C or G
agngnnnnnnnnttnncttatgcctaatagcttggctacttgttctttttgcaggatcccatcgattcgaattcggcacgagctgaagtgaggttgaggtgggtgcacggagcccccatgccctcagtgggtacaccagcctcccagcacttcctcatgttcaccaacacggaagcttatcagagcttgttgtttcagaactcaattgccagctcactgctgaagagattggtgggtagggctgaaagaaatatcagtgggtctttgtggtattcagccccatcctgagatggcctatccaggggctctataagaagtcacctcattagcataaactcacatgtgaccaaaaggatcttgttatgaataacaaaagatgttcttattactcaggaaatcccaagagtttagatgctctgtgtcagggaagtggggatgcagaccaatttcttattctatcacattaaccagaatcaagcttataaaaatgtatttttttttgtatggtcctcantgtgcctacttgaataatttttgctgatttgattaaaaaattctgnttttccattctcttttattagctgtcccatagttttaatacagccatcatcccaagaccagaaggaagttaagtgctcatttataaaaatgattgnatcctncttttccatctattacttttgngtccattatgcatgtcaagctggtgcttgggagcttactctntgnaccctctattagacagang

SEQ ID NO: 3919 - DNA, 723 bp, Homo sapiens
  misc_feature (1)...(723): n = A,T,C or G
ttgaanctaatgcnggctacttgttctttttgcaggatcccatcgattcgaattcggcacgagctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccactatggtaattgtgctcctttttttccccctctctggttcacctgctcaatggtttaaca

SEQ ID NO: 3920 - DNA, 723 bp, Homo sapiens
  misc_feature (1)...(723): n = A,T,C or G
cttcttgctaatgcttggctacttgttctttttgcaggacccatcgattcgggaaagttccaggaccctgagacatcttgggattcctgtggtttaggaaagacctttaactaccagctggtagttgtctcagcattcttcaaatagtccggtcttgtttaatattattattattattgttatttaattttattttattgcaactgtacttagagaatagtctggtcttgagaccttttcactgtggtctgttctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcagaaggccttccccaggaggcctccaacagatccctgaatgccacagaaacctcagaggcttgggatcccaggaccctccagcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggnactttggccaaatcttgtgtgacatctggctgncctctgan

SEQ ID NO: 3921 - DNA, 719 bp, Homo sapiens
  misc_feature (1)...(719): n = A,T,C or G
tagctaatgcttggctacttgttctttttgcaggacccatcgattcgaattcggcacgagccaagcagaccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctcttctgttttcttatgtgtgtaataagatatacaaagtcgggcttgaagattagaaattgctacttccagtgagtcagtttacttggttttcacatcttcaagttgagtctagaatggagttacctaagaaaaggaaatttgcagccttcagtaccgtgtcctggggttgctagaataactagtgccatatccactctactggctctctagagattgtgtaaaggaggctggccttttggagatgatctgaatacatggtattgaggacaaaccttcttcccaaggctgatttgataatatgtgagtttgtgggtctaacatgtagaaatacactcaactgaatggatgtggggtaatctgggtatttagacagggtggtttggtnggtttaatgggnccaaaccttgtttnctggaaaa

SEQ ID NO: 3922 - DNA, 745 bp, Homo sapiens
  misc_feature (1)...(745): n = A,T,C or G
agngnnnnnnnnttnnnnnnttntaanctaatgcttggctncttgttctttttgcangcacccancgattcgagtgggtagcaaggagttctgtgtaaatacttgggaggcatccaagcggagagttaagtaggcactgaatatttaagttgagctgaggggagtgatctagactggacataaattttgggagtcactagtatacagatggcatgtcatggaactgattganattgtttgtggccttaagatcaagccctgcnagactggagtaataaaactctggtctcccacacagtcagctctgngtggggaaaaaaaagccctaaaacactaacaacggctaaagcttgggcaaagganactgaaaaggttcagccnttaaagtgggagagtattttattattttcaagaaagagggaatggtcacctctgtcaaatgctgntganaagttacacaatgagaatagagaaatgtctatttggatntgacaacatgatggtgactgttttgacaagtggnccaagccacattgggatgcttcgaagagagaataggaagtgaggtgaatatcgacagctcgttagggaaatttgctgctgtaaaatggagagaaccacttaatgcttcaganggaaatggggtcaaaaaaaaaggcttttttttttaatttttttaanaacaggaggnccttcanncatccaggttggagtgcatggngcaaattnccggttaccaaanacn

SEQ ID NO: 3923 - DNA, 747 bp, Homo sapiens
  misc_feature (1)...(747): n = A,T,C or G
agngnnnnnncnnttccnctnttgnaacctntnatggcttggcaactngttctttctccaggnagcccatcgnttcgaattcggcacgggcctagtagtaccctgacctccaggtgcccctgactctgggaaagcctttctgatgatctcaagcttgcanattctgtccctgttctgaccgggggtcacagcctagtggtagaacaggacctcctgctaagatgctggaaggaccctttgggggagctgaggcctggctcccctctccccaggcgcaggtgcacaggcgtgtgggctgtctgcaagcacagatcctgcctcacagcaccattaccacaataactgaatctgtgtttcctggctgctgttaattgtgctanagatttggggcatggttttggggtgaaggttnnaaatgagcaattagccctnaaatgttaaactaataagggaaataaatgatcaagcaaagtctagcctangaggtttcagcaaccgaagatgggctgggacggggctgggatgccgccgacccagcagggagtggcccancnggtttgcttcaatgacccangatgtttccacaantcggaaaggggtgctatcttnctgtctgctacttagaaagttctatcttacccccnggatctnacttacaccaccagancattactggtctacccgncaaggctcttctgctcaagaagacagggaaaggatttgctttccccacnccattannacccc

SEQ ID NO: 3924 - DNA, 743 bp, Homo sapiens
  misc_feature (1)...(743): n = A,T,C or G
ttntnnnctacttgatgnttggctacttgttctttttgcaggatcccatcgattcgaattcggcacgagaaaaaaacanaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcatttcacgtttccttctatttgatttacaagagggtgtagcttgagggaaaatgcctcacacttgttgaattacacagttgtttctcattcacttttaatcacgttttgagcacctgctaagtaccaggcattttgctaatgaggagcacagaggtaaaagacacatcactactgtatgaaatgcgtagctcantggtgtgatacacaagcacagagaggtnaccagagagcaaggagggcatggaaganaggcctntnacttttggactgggaanggagaaagatgtangacaagaaaatctttcccttaaggagcttgatgctttgaacttgtgccctngnggaatgaanaagttnacccanttngggcttancnt

SEQ ID NO: 3925 - DNA, 743 bp, Homo sapiens
  misc_feature (1)...(743): n = A,T,C or G
gnanctaatgntgcttggctacttgttctttttgcaggatcccatcgattcgtctagactctggtcgtcaggaacgggtcaaggccttcaccatgagaagagcaccaaagggagttaatatggggttgaccagaggtaggcaaaggaaggcctgtgggccaaatctggccagctacctgtttttataaataaagttttattggaacacaaccatgctggggtttgtttcatatttcctgaggctgttttcacactgcaatggcagaggtgagtggttgacacagatgccgtctcaccaaagcctatgatatttactgtctggccctatacanaaaaagcttgctgacctctgggttagactgtcaggtggtananactaaggagggagtgataagtccctgttggccacctgaggttttgnctgtgtcaggaagctgcagatgggagatgtccaggcagtggctcanaagaacccatggaggacccattaagggaanggttggtatgtggacaccanccacgcccangtgaaccanctgtgcagtcaaatacanaacttnccgtcccttacaccttccttctctgnggtttcaattttagtgaaagtcanccacaccncanangtngaaccaacccgtgcagtcaaaatncaaaactttccttgcccctttaaaccttcctttttncctggtttccaatcctggtggaaggtccataagccccagtccntgaanccaaggnng

SEQ ID NO: 3926 - DNA, 787 bp, Homo sapiens
  misc_feature (1)...(787): n = A,T,C or G
ggggnnanngcccttnctccangcngtaactctcgggaanggcccggcnncttgttcttncnncaggnagcccatcgcttcgctcnacnacatnnctgggccctttttcatggggattnatgncnagtgtnnngggacaggaccattcantggctggnttnnaannttgatggngtnaantgcnnntagaataaanngaacagancaaaataangnnnggntagnaggaagatggnatgcacatganaagataanggcagcagnanaggtgagggaangagtggatatnggggaatgacnttatnaangccangaaactagaatctnagngacggaaaagctnnaaaagntctgagncncttnncnanacggngggtacccnggggtcgaacaaaccgncttctttgacatgttgtancatactgaacanggnntccnaatcctgcggccaangnaagacacgnagnctanccnagtcgctanngccnnaaccaatggcnattncnaggcgtgatctaacgcactacagcttgnactcctgggctgaggcggganaatcacttggacccaggaggcatgaanttgcangtgagnctnagaacacgccaatgncatacgcctngnnccccnanggnccnaaaacccccggtcttaanaaaaangggacccaagaaagggnggaatcccccaaccccggcccnntagaaccatnntcaccctaaaggggaaggnnncttttanggaaaannanccgggcntggggnaaaaaaacanggccttntaggnc

SEQ ID NO: 3927 - DNA, 736 bp, Homo sapiens
  misc_feature (1)...(736): n = A,T,C or G
tntttgnaanctaangcttggnagctngttgttcttncnncaggntnccatcgattcgtctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgactgcaataaatgtgaaaaatggctattacaattttgacagcatcttgtagaaagtgccaatgtcacggccatgtgggaccccagttaaaactcccaaagatttgtaagcccnaaaantggtgantgcatcaactggcttcatacacccactg

SEQ ID NO: 3928 - DNA, 753 bp, Homo sapiens
  misc_feature (1)...(753): n = A,T,C or G
agggnnnntnnnnttnnctactgnaacctctaanngcttggcnacttgttctttttgcaggnagcccagcgattcgaattcggcacgagataacctaggtnttagaaggataggaacaacaaacatcatgatcttacacacctgcactttctagcaccagctcctggagaaaaatcgagaggctgaatggtgtctgttaacagattatagtcagtgaggcctctttcctcagatgttgtatcttatcaatggcagacattttcaacctgaaagacacatgctcattacaagacttagtagtgctctaaccctgttttcacttatcagtccaagacgtagccgacatcaaagtattcagcttattacagaattgacttcctcaaagtttctctcagtgtttatccaagatgtaattcacttagcatctttatctcgctgcacaggactagagttgccttcgaaaaaactcaggataccacttggctatagatcacagtacttgttcctcgtatttgcgttaactngtgtgaatatgcagcctccgtgagatatttgcatactgcttctgtgaacacacaggacaacagactgtcttccgcagtcatacactcagtcatattctcaaataggtattccagttcaaatgtataaaatcagtagtcttacatgttacagantgggtgggatgttcctttgccaggggattaaaaaaaaaaaaatcccaagtcttaatactgntttctnccnacgaat

SEQ ID NO: 3929 - DNA, 754 bp, Homo sapiens
  misc_feature (1)...(754): n = A,T,C or G
ngngnnnnnnntttnnanncnnttggaaacctgtgcnaggctcttgttctttttgcaggnacccatcgattcgattcggcacgaggtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtnaggaaggtaagttntttcataggggnatgcanacatatnattgaaatattacatagatntaaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacangtatttttccaatgcaagatgaggatgaaaatnttacattttaacccatctggctaaagtttagacttagcaaaaatnaanatgntgcctttgnccaagtatngattcangngactagacatatatgggtgtgtaataagganggattggactgaaatatnntttgcagggtttcacatgtaaaactgcacttgccctgnaaggatnntggnaanaatctgngtttttcctcagncnncnttnagaacagtaaggggncctaacctnntttaacccgtaaatg

SEQ ID NO: 3930 - DNA, 788 bp, Homo sapiens
  misc_feature (1)...(788): n = A,T,C or G
gnnnnnnnaagngnntnnnntttgatancntnttnaancttaanggcttggctacttgttctttttgcaggctcccagcgattcgaattcggcacgagcccgccacatggcctgtttctttccttgctgctcctgcagcacagccctgactcgggggctttgcgtgtcccctcancgctgcagggcccactccttcctctgtcctggtctctgcttagccagcgcacggtcagggaggcatgggtggccagcccgcaaggagccaggcctcccagcaccccttcccttgtgtggcctcctcccacatgggatctcagccggtcctggcttcaactaaacaggacgtggcaggcgtgatgccctgccaattccaggcctaagccttgacacagcctggcagcttctgcttctgaattgcaggaccccaactgtcatgtaaagaagtctggctgctttgctggaaaggccaaatggagagaccacgtgagaggccacatanacaggccttgtggagagggaaaggtgctgagactacctggaangggagcccagttgaccaaacaccccccactgagcccatcccccagncattccttgccaggacacccaacatgtaagtgangcatcccgggccgttccaancttggncaancgccantgggactgtaacttgcannagnaaaaattttgctttnnaacnaaaagtacttggccnancntgaanccccanttnngtcccacannaattccttggagagnataaacccaaattgaattggttggttnca

SEQ ID NO: 3931 - DNA, 460 bp, Homo sapiens
  misc_feature (1)...(460): n = A,T,C or G
ttcnaccagctcttgttctttttgcaggatccctcgattcgaattcggcacgaggcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacag

SEQ ID NO: 3932 - DNA, 719 bp, Homo sapiens
  misc_feature (1)...(719): n = A,T,C or G
anctaangcttggctacttgttctttttgcaggancccatcgattcgaattcggcacgagattttaagtgtgcagctcagccgtatttagtgtattcacaatgttctgcaaccaccagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccagctgagatgtgagggttctttgagcccaggaggtccatactgcagtgagccatgattgggccactgcattctagcctcagtgacagantgagactgtttaaaaaaaaaaaaaaaaactcgagcctntnaactatagtgagtcgtattacgtagatccngacatgataagatacattgat

SEQ ID NO: 3933 - DNA, 742 bp, Homo sapiens
  misc_feature (1)...(742): n = A,T,C or G
agagnntnnnnnttgttgactctaatggcttggctactngttctttntncaggagcccagcgattcgaattcggcacgaggcctggcgaattttttttgtatttttggtagagtttcgtcatgttgcttaggatggtctcaaactcctgagctcaagtgatccacctgcctcggcctcccagagtgctgggattacagtgtgagccaccatgcctcacctagggtgtttggtttttaagtgaaacatgcacatggtaaacattaaaaccgtctaaaaggctggaccatgaaaagcaaggctcccttctcccacccaatccctgaattctccctggagagtatccctcctaagtgcacgcacttccactctgttccatttctgcctgttaaaactacttagtgcagcttagtgtagtggaacctgcttcagaataacccatatgggtcttctttattctcatgaaccacagagcatttcatgtgttggatatattgtctcctacttacggacatttggggttgtttctgtttttgtttgttttgtgacggactcttgctctgtcacccaggctggagtgcagtggcacagtctcgctcattgcaaccttcacctcctgggttccaacgattcttccctctcacctcccaagtagctggggactacaggtgcctgccaccatgcccactnatttttggattttttggtaaaacaggggttcaccatgtttggccaggcttggtn

SEQ ID NO: 3934 - DNA, 799 bp, Homo sapiens
  misc_feature (1)...(799): n = A,T,C or G
agtttnnnanntnaacnnnttgctgccatagcgtggctttttgcaggacccatcgattcgaattcggcacgagggggcccccatttttctcaaatnccctgagcctcaagaggtggnggaagagttgaagaagtacctgtcgtanggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggnttnggtttaataaaagttgaaatanagtanatgaaaganaaaananaaactcnagcctctagaactatagtgagtcgtattacgtagatccagacatgatagggatacattgatgactttggacaaaccacaactagaatgcactgaaaaaaatgctttatttgtgaaattcgtgangctattgctttatttgnaaccattataagctgcaataaacaagttaacaacagccaattgcattncatttcatgtttccaggttcaggggggaaggncttggggaagggtttttttaaattnnacggggccgccgtggnccaatgccnttggggccccggtaccccaagcttttnggttncccttttantgnaaggggttnaattggcccccccttngggcnttaaatncatngggncantaacctnggnncccccnggggtgggaaaaatttt

SEQ ID NO: 3935 - DNA, 834 bp, Homo sapiens
  misc_feature (1)...(834): n = A,T,C or G
agagnnnnnnttgannctaatngctggtngctcgttctttntncaggagccnancgantcggtaaattcctgggttccaggctcaagccttccactgtatgctccatgttaccagctatgccttttgaacgggagatgttgcataaataattgttgagtatgcactttagattctttgctaacatcacatttggtgaaactataaaataattcccatgaaaattggattgcttaatatcataactgatatttaataatatttaatattgctctaaaatttctggctaaaatgaaaatattcaaccatcaggaaggagaaacaaaactattactgtttgtaaacagtttatcatcagtacttacctaaaaatcctggagaatgagctcagaaatatttctaagagttgagacagtttagcaaaatgaacagatacaacctcaaaccaaaccaaactagaaagctcagaggacacagaaatgccagtactgagctggcaacacctctgttgtttgtgaaaatgttctctggaacacatggacacaggaaggggaacatcacattctggggactgttgtggggtggggggatgggggaaagggganaantncnnngnnnnnnnnnnncccantnnnntnnncnnncnnnttnnnnnnnnnnnnnnnnnnnnnnnttnannnnnnnnngggnnnnnnnnnnnannnnnnctttggnnncnnnnnnnnnnnnnnnnnnnannnnnnnnnnnnnnnnnnnnnccnnnnnnaaaaannnnnnnnnnnntnnnnnnnntnnnnnaaannnnnnnnnnnnnnnnnnnnnnnnnnnnnnnnncn

SEQ ID NO: 3936 - DNA, 748 bp, Homo sapiens
  misc_feature (1)...(748): n = A,T,C or G
agagnnnnnntttttgaanctaatggctggctactngttctttntncangatcccatgcgattcgaattcggcacgagtggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactgttcatcctaagttccactataaacaggctcatgactcgggcacagacacttttgcgtgactttttcctatgatggtaatgtccttgcctctcgtggaggtgacgattcattaaaattatgggacatccgacaatttaataaaccacttttttcacctcgggtcttcccaccatgttcccaatgactgactgctgtttcagtccagatgataagctcatagtcactggtacatctattcaaagagggatgtggcancggcaaacttggtttctttgaaccgtaggactttccaaagggtgtatgaaatagacatcccagat

SEQ ID NO: 3937 - DNA, 747 bp, Homo sapiens
  misc_feature (1)...(747): n = A,T,C or G
agngnnttnnnctttgaatntnatgctggctacttgttctttttgcaggtngcccatcgattcgaattcggcacgaggtaagatcctgcctcaaaaaaaaaagtttatgttctcaaagtgctcataatctagtggtagtacagtatttgagatattagagcagtttctcctccttttgcaactaaggacatgtatccttaaagcagaaggaatggcagagtcgtgtaataaaccctcaagtaccattacttagcttcaacaactatcgacactctactgttcttgtttcatttatgcctcacctccttcccatcccccacttgaatattctcatcctttttttacagtttttaagataacaattacataactgaaatgcacaaatcttagctgtacagttttgacatatggatacacctgtgtaaccaatgactgtatcacaacatagagcatttcatctccccagcaagatccatgtgtcttttcctagttaatgcctctttatttctgagatggttattgctctgcttttgtttttcatgttaggctagtcttgcctgttctagaatttcatataactgagaacatacagnaatgtactcactagtagtgtctgactttttcacaaaggataatgtctggcggtattcattcatgctgggngtatgcatcagtagttnattntctttttactattaagtagtgttctaaggactattttaatagcatnccacaaanggggtntga

SEQ ID NO: 3938 - DNA, 747 bp, Homo sapiens
  misc_feature (1)...(747): n = A,T,C or G
agttnttcncangannactnantgggctgccctactcgttctttttgcaggnngcccatcnattcgaattcggcacgaggtgtgggtcantttcatcaagtactttacaaggtaatagaatatcacaaggcaagtggaggcagggtgagatcacgggaccagggcgaaattaaaattgctaaatgaagtttcgggcaccattgtcattgataacatcttatcaggagacagggttttgagatcaaccagtctgaccaaaatttattaggcgggaatttcctcttcctaataagcctgggagcgctatgggagactggggtctatttcacccctgcagtttcgacagtaagagacggccacgcccagggggccagttaagagacccacccccaggtgcgcattctctttctcagggatgttccttgctgagaaaaagaattcagtgatatttctcccatttgcttttgaaagaagagaaatatggctctgttccgcccggctcaccggcggccagagtttaaggntatctctcttattccctgacaatcgctgttatcctgntttttcaaggtgcccacatttcatattgctcaaacacacatgctgtacaatttgtgcagttaatacagttattacagggtcctgaggtgacatacatcctcctcagctgacaggattaagagattnaagtaagtaaagacaggcataggaaatcacaagggtattgactgggggaagtgataantn

SEQ ID NO: 3939 - DNA, 810 bp, Homo sapiens
  misc_feature (1)...(810): n = A,T,C or G
agncnttnnccanntnnactnctntggctgcncatactcgtcctcgcccnannangacagggcnnggcgaatncggcacncagaggcaggtgngttttttaaaaggtnaacacaccngttatgccttcnngtacgggcatgcgagccagaagantntgcanctgcnnggagagatgaagcnaaactntgcaacattcaactgcattaaanaaaaatgatgccnanagggcctttgagcaagaaatgnnggnngatnaangacacccgnngccngaactctgcgcgggacatnnnggttatggctctgtnagctcntaacnctgcagntgacccagacnnctannggcnggactaggggatgangcggctcactgtgggcnntncgtgagaccncaggncanncatgatgactgnaaacagantcccananactctactggatcctcccttttccttgctaacacatgaaactgatccaggatacacagcgcaanaagnatctgaatggcagtgaattctcttnaacataacccgcnatggcnatnggggcttcantggaatagangggtacaggtcaacnggggttgaccctgcggnttngnnnggncancggcnttntgagncanaaatacncgtaangccaantttacagccatgaancaaggatcccccnttngggntttggggatcatcacggnattgntgttggtggcantaacgctgaaatggaaaagggaaccttgccccttanatgaccctttggggaaancccctnaaaanggaatcgtaaaagnccaancnccaangtcg

SEQ ID NO: 3940 - DNA, 749 bp, Homo sapiens
  misc_feature (1)...(749): n = A,T,C or G
agagnnnnnnntnttgactcctaatggctgggctactngttctttntncangtngcccagcgantcgaattcggcacgagataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggaagggtcctttctccctccttttacactcgcagacaagcttgtggatgctcaataaggacagctgccgtttggacagagattaatcatttatttgtgaaggttttttctgccttgctttcttgttcttttttaaatcttcacattgttttgatcccaaaatgtttgtgttgtccttactcaaaactaggaaaaacaattatgtggtaagaggctcagagccacttacttaaatctcactagatttatttgtgagaacatctgttttctgatatttagacacttnctcttccattgctgtttcctatgactcatgcacagttatttgttcaggtttcatgggaatttcccaagtgtatttacctttgtttgggtttttaaaaatgtaaattatattggcccaataaatgagtatgtgttgtcanggggactgtggctgggtcattgcatgtggaaggggaan

SEQ ID NO: 3941 - DNA, 740 bp, Homo sapiens
  misc_feature (1)...(740): n = A,T,C or G
agngnnnnnnttttgnntctaatgcttggctacttgttctttttncangttcccatcgattcgaattcggcacgaggggccatgtacctcccggacaccctctctccaccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggactgctgaaggaggatgtgcaggactacagcgaggacttgcagggagatcaagaagggaactttcaaagactggtgaagaaaaattccgtggaagaatctaaagccagcaagagattgacnaaaagggtgcagcaaatgatcgggcagatcgatgctttgatctccactggagatggccacagcttgcagctggcccggcaacggatgccct

SEQ ID NO: 3942 - DNA, 746 bp, Homo sapiens
  misc_feature (1)...(746): n = A,T,C or G
aggtntnnnttttgaccctaatggctggctactngttctttntncaggttgcccagcgantcgttttaccctcctataatgcattttctttggatattctcctagattctcagggatatttccatattttactattcatgagtttagaagagtgtttactttcctgagttttcatttccttctttttcttctgtcataggtaatttacagagcaaatagccaccagagaggataccgtaagggatgtggaaaatgagttcctttgcgcttatccagtgaggttgattttcagtcaatgagcattcagtatatgcctgggactctggctttattttttagctttgtgatgccaaacccatcaatgaacttctctgtatatttgattcatcatgaaatggtgacactgagggtggctgatttccaggtttacatcagttgccccaggggaagtgcctggcccttgtctggttgttgctgctctaactttgccctgttaattgaagaaatgcggctgtaaacacttctggggtgttgctggtattttctgtcctcacagtttacagagaaacccatattttcagcctcttcctctgctttctgtcttttctggaaccatcttcaccgacctggtgtaatcttcattggngtgtgantntgcacagatgtaacatctnctcaaagcctantgcccaccttccaacttcacgaaaatctggagctcaggaccaccattctttccaaaccct

SEQ ID NO: 3943 - DNA, 743 bp, Homo sapiens
  misc_feature (1)...(743): n = A,T,C or G
agtnnnnnnntnttgactctaatgctggctacttgttctttttgcaggatcccatcgattcgaattcggcacgaggggcaggctttgagaggatcgactgcaattttgaaagaagttgtaccgtgagtaaaatgcgatcaaacagcattgcatgcttcagagaaatctttcttcacaaaaggaacaattggtgcagcaaaattaattttcttattttaagaaattgtcagccgggtgtgagccaccatgcccggccgacataggctattttttaaaatgcaagctcttctgaaccatataatatgatgttttaaaatatagactctgaagacaaagacctgggctcagaatcaggccccaccacttattttcaatggaatcttgtctgaatcttgtaatctttccaagcctcagttttttcatctgtataatagggataaaaataatagtaaacaaataaatgtatttcttttgaatatctagtagtattttaaaaatcagataactagaattatataactctatgtgctttattttttacttgtttgctgggaatcaaagagcttagttttgttttttgntntttgnttttttttgagaccggagtctcgctctgtcactgcactacagcctgggtgatagaatgatactctgtctcaaaaaaaaaaaaaaaggaaaaaggatgaaatcacacttggagcaaaaaacccaangcatatttaaagatttgngtattgggttaa

SEQ ID NO: 3944 - DNA, 754 bp, Homo sapiens
  misc_feature (1)...(754): n = A,T,C or G
agtnnttnnnnatnggaaaccnttatggctnggcctactngttctttttgcaggagcccatcgattcgaattcggcgcgagattgcncattgnttttatctgtaagttgtctttatcagtggttctcaaagtgtggtcccctgctagtatagtntcagcctcacattggaactggttagaaatgcagacttctcaggatccacctaattgcagnagttaattttaacaagcccttcggtgatcctgaaacatgttacagtttgagaaacactgctataatacgtgtcatttnaaattgnttcaggttgtgggggtagggaataagactaccaatttattcatcttctgtgcaatattacctgtttacctaactcttagagatattaananattttgaagaatgtgtcccatgagattataatggaactgacaaattcctatngcttagtgatntcatagctgncatgaagncttantgctgtaccttactcatgtgtntgnggtggngatngtgtacacaaatcttctgcactgccagtcgnctgaaagtatagcacatggccgggcgcggtggntcacgcctataatcccaacactttgngaggcttgatgcaggcagatcacaaggtcaggnanattgagaccatnctggctaacaccggggaaaccctgtctcttctanaaatnccaaaattagctnngtgtggtggcncacgttttgtaatcctggctacttggangctgaagcaccaga

SEQ ID NO: 3945 - DNA, 749 bp, Homo sapiens
  misc_feature (1)...(749): n = A,T,C or G
agtnnttnntnnatnaactnnttgctggctacttgttctttttgcangatcccatcgattcgtctcaccgtgatcaagttgaggggnttncggctcccttctacagcctcagaaaccagactcgttcttctgggaaccctgcccactcccaggaccaagattggcctgaggctgcactaaaattcacttagggtcgagcatnctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgntccggagaccgtcactncaggtgcattctggaagcattanaccccaggatggagcgaccaacatgtcatccatgtggaatcttggtggctttgaggacattctggaaaatgccactgaccagtgtgaacaaaagggatgtgttatggggctggaagtgtgattaggtangagggaaactgttggaccgacttctggcccctgctcaacactgacccctctgaatggtnggaggcagtgccccagtgcccaaaaatcccaccattantggatcggnncntatgaaaaagaagcctggaaaaagtattggggccaatgtgttaagngnggaatcancacattcntactgnnat

SEQ ID NO: 3946 - DNA, 749 bp, Homo sapiens
  misc_feature (1)...(749): n = A,T,C or G
agnnnnnnnttnnntctttgngcctaatgcttggctacttgttctttttgcaggnacccatcgattcgaattcggcacgaggacttgatttggtaatgaaaggacaaatagctttcataacatgaacatacaaaaatagatgctttgctgttgttcagttttctcaagacttactgttttaagcttgtaaaattaatgaacagtaaaatagcagaaaatagtgatacattggatgattttaatagttttattagtgagatatttgaggtattcgaattactacaattctttccaatcctacaagttaaaaattttgttatggttgctgacttttaaatgctgtttattctctgaaggcagttttatgatgcatttagaaaaaaggtaagagagatgtaggcattatactggttcatcttttacctaatgcatgaccagtatactagaggaagttgtgatggaccagagtctttttgttttgtaatcaaatgaatagttccttcataaccaggacagctagtgtgtgcttgagaatgtctccctcactatatgatctgggatattctgcattaaaaggactcccttcccagtattgggagaaagagagatnaattgacacatttttactctgactccttcatttatctttccacataccaggatcattttggncttttaaaatgtccaaggttccaataagtttaaatggtattagtggncttctacatttgatcagtaatgnagatggc

SEQ ID NO: 3947 - DNA, 741 bp, Homo sapiens
  misc_feature (1)...(741): n = A,T,C or G
agagnnnnnnttttgactcntantggctggctactngttctttntncangnngcccagcggttcgaattcggcacgaggtccatctttgtagctgacatgacacattttaaaaatttcacattaaaatgaaggcatctaatggctccattatgtcttttagagtggtctggcccagctaattgcatattgaaatacattagatttgtcataaattactttcctttattgtcttttctgtcaatcttaggacattaaatgtatatgtttgaaattgtgtttaggtnggttatctgagcatttggttcatatagtaaagagagtgttataagttcactgtaagccccaggggctttgggactnatnnggtttanaacattgcactaggggaaatgaattgttaagnnatgnnacttctctanactaatgantcatctganttaatacttttcatgtgaagcatttttaaagaaagcaaaccagcctggtgcggtggntcacacctgtnatcccagcactnngggaggcagangcnggctggatcacgangncaaganattgagacctnctgnccaacatggtgaaaccctggctctactaaaaatacaaaaattagctgggcatantggtacntgcctgtagtcccagcttcttgggangcanagcaggagaattgctttgacccgggaatggaggttcantgacccaaatcgcgccactggctctacctgcacaaatgagat

SEQ ID NO: 3948 - DNA, 847 bp, Homo sapiens
  misc_feature (1)...(847): n = A,T,C or G
cnntttaattccatcagctcttgttctttttgcaggatccctcgattcgaattcggcacgaggggtgcttctgtatatcctgacaacagtggccagccattaaagagttttgagtaggggaactggatttgtggttttagaaagatcatttggcttctgtgtgaaagaggccaaaaccaggagcagaaagaccagttaggaagctgtgacagcagttgagagacgatgttgtcaaagtctgcagcagaacagaacaggggtgaccccacatggacatcatctctgctcttcagtcacctgtagtgcagagttttgaagtaggtctgagcatggaacccgtagtggttgggaaggaaatgccatttgcctatggggtgattaagatctttttttttttcctcaggcggagtctcgctctgtcccccaggctggagtgccgtgacgtgatatcagctcactgcagcctccgcctccctggttcaagcaattctcctgcctcancctcccaagtagctgggattacaggcgcccaccaccacgcctggctaatttttgtatttttaanngnnnannnnnnnnnnnccntntnnntcntnnnnnnnnnnnnntnnnnnnntnnntnntttnttnnnnnnnnntnnnnnnntnnnnntnnnntnnnnnnnnnnnnnnnnnnntnnnnnnnnnnnnnntnannnnnnnnnnnncnnnnnnnnntnnnnntnnnannnnnnnnnnncntntnnnnnnnnnnnnnnnntnnnnnnnnnnnnnnnnnnannnnnnnnnnnnnnnnnnnnannnnnnnnnnntnnnnnnnttnnnnnnntnnnnnnnnnnntnntcn

SEQ ID NO: 3949 - DNA, 743 bp, Homo sapiens
  misc_feature (1)...(743): n = A,T,C or G
agagnnnnnnnnnttnttnaccnctaataggcttggctacttgttctttttgcaggnacccatgcgattcgaattcggcacgagcccaccttctctctctcattgtctgattgaaagcaccaggtctcccacattgctttcatctttgtgctgtttgttgtccctttccatatctgtatttatgctacctgttagggctcttgccgaagcaggggtgggaacaagaaccacagatatacttctgtggtttgtgaagcattgtgtggagggctgtgtacacagagtacctggggcagttgtcacagccactctgtgtggtagctgctactgtgcccatcttagaaatgagaaggctgaaggacccacccagggccacacagccagtatacccaaaagtcatacatttgtactctgttgctgtctcctgtcctatagtaccacgcactagggctcctgtccatgtgcgtaagaatgaccgcctanccgtcaataagatgatcagcaaggtcacacggcatggcttaagtctccctttgcctactgcatgatgatcccgggtggccagcaagcagctggaagaggaggatggcaggtaacggctctcatctctcaccactagatgatgcctnactcatcctaccatgctgggccaccccaacgttttcttgccacctatggtcttttgtancccgtgacagccactgtttgacttcatcganacttnttgcgcaacaagcacgaaa

SEQ ID NO: 3950 - DNA, 740 bp, Homo sapiens
  misc_feature (1)...(740): n = A,T,C or G
agtnntnnnntntgaagcctctaangcttggctacttgttctttttncaggacccatgcgattcgaattcggcacgagggcagatgtncttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgcgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccacctcaggtcatccttttaatctttgctgacngttcaatcctgcctctactgtctcttcataccctggtgggggtcccccttntttctccatggacagaanaccaccactggggatggggaattaaagttganaacat

SEQ ID NO: 3951 - DNA, 744 bp, Homo sapiens
  misc_feature (1)...(744): n = A,T,C or G
gagnnnnnntntnttgtnnctaatggcttggctntngttctttntncaggctcccatgcgnttcgttcaatagcatgttaagtagatattatctgacagacctacaagtctcacttatccgngacatcagacgaagagggaaaaataaagttgctgcgcagaactgtcgtaaacgcaaattggacataattttgaatttagaagatgatgtatgtaacttgcaagcaaagaaggaaactcttaagagagagcangcacaatgtaacaaagctattaacataatgaaacagaaactgcatgacctttatcatgatatttntagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgcagtagtaatgttcanaaactgattattcggatcagaaaccattgaaactgcttcaagaattgtatctntaaattctgctacttgaataactcagttaacgctgttttgaacttacatggacaaatgtntaggacttcaagatcacacttgtgggcaatctgggggagccacactttcatgaantgcattgnatacaaaattcanagttatgtcccangaataggtttaccatgaaaccccattnnc

SEQ ID NO: 3952 - DNA, 764 bp, Homo sapiens
  misc_feature (1)...(764): n = A,T,C or G
agagnnnnnnntntntttgtctncctaantngntgggctactngttctttntncaggnatgcccatgcgattcgaattcggcacgaggctcattccagctggtctatcgtgggcctcacaaggtgaagagggaccgcattctggggcccacgatngaccacctgtagctnattccatcctgnaccttgnatgaggggtagcctcccactgcatcccatnctgaatatnctttgcaactccccangantgctnatttaagtgttnatacttttnagagaantgcgacnatncaattgtgagatctccncctgcccattgcctgntngnagggcacctctnctccaccnnnatgganngggnngcagctnaanggccctnanacgganctgntttcatnaagatnacattacacngagnngagctaactggcctgnatngaaangntnnttatgancnaagnnacaanctttttaanngttcctganannacttgngncnctagaacaatagantgtccaattacaaagatccncacntgatgcnatacnttgatgagcttgactacaccncngctttaatgcaannncaaaaantgccctntttngnaaatnnnacatacatncgttttangantaaccatncanaaagttgnattanaccangttgaacnccncaatgnnccttcaattttaannggctaggntnngctganggtnanggaccgcccnntnttgtttgctcggccnggnaatgggattggccct

SEQ ID NO: 3953 - DNA, 748 bp, Homo sapiens
  misc_feature (1)...(748): n = A,T,C or G
agagnnnnnntttttttntcnactaatgcttggctactngttctttctncaggntcccagcgattcgaattcggcacgaggtgatgctggtgatcaatggactggaagccaacagcagagacttagacccaagaagggagcttgaggtacaagaaaacttcagggtagacaggaaggaggcgtggtgaaagtgatgaaaggggagagtagaagggtggtccagggtcagacagggagttagatttaatccttcagggcactttcattacatcatagctgccattttgtcttttatctgactcaataataagtcagtaataagtaatgttttaattaaaggtaaatgcttggcaggtaggttaaacttcattgagtcccaatcctgtcataattattgtgtatacctttctcagctttttgtctacttgaaatatatttcttcttcctttgagcagccaaaatggaagtgttggatgtgttggctctgttggtaggctcctgttggatgcctgttgtcactcataaatgtaacaccacaaccataattgatggcanagttgagttgcaagcttttaggactaattgcaaagtctaaactaaaacatttcctgganctgcctttaaataataataataataccttgtatagatacagtgctttacaatttacagagcacttccacatacatcatctcatttaatcttcacaattaacaatgcnttttgaatgcttagatatttcctangg

SEQ ID NO: 3954 - DNA, 748 bp, Homo sapiens; identical to SEQ ID NO: 3953
  misc_feature (1)...(748): n = A,T,C or G

SEQ ID NO: 3955 - DNA, 749 bp, Homo sapiens
  misc_feature (1)...(749): n = A,T,C or G
agagnnnnnnnttgttnnctacttnatgcttggctcttgttctttttgcaggctcccatcgattcgaattcggcacgagcgcataaggaaagctggaaaataacctataaataatggcaaaaaaaaagcaaacaataggaagaggaactatataaaaggaacatttggagcatagaagagagttcatggaaatgtaaaaaatgatggtaccctgggtttgatatagtaagtaaaaaactaagggtaagagggtcatgaaagcatctanaantaggagggaaagccagtcaaattcacaggatgaagtcaggaagataatagagcantgcccgcangatcctgagggaaagcaagttccaatctataagtctgtaaccctcacacctgatggccccttgaacatattcagggcttcaaaagattgatctgtcatgcaccgtctgccatgatactgtgtgaggatgtgttcttcttcttaaacattaaatcaagaaagaatcatcagtggacccagtnaatancanatcagcctaggataagatgccctagaagatggtgaanggaagtctcagaactactgttcttcancaggcagcnaanacacctgatccatattggagtggtgggatgcgagcttcaggaagggatgccacaagggnaaagtggaanggatgatgactgtcttcaagaagttacaggtctttaagaatttacatccaacattactttngcttcgaagccccggctga

SEQ ID NO: 3956 - DNA, 749 bp, Homo sapiens; identical to SEQ ID NO: 3955
  misc_feature (1)...(749): n = A,T,C or G

SEQ ID NO: 3957 - DNA, 750 bp, Homo sapiens
  misc_feature (1)...(750): n = A,T,C or G
agtgtnnnnttttaatccctactaatggcttggctacttgttctttttgcaggnacccatcgattcgaattcggcacgagaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattntattccctttttttttcctttaatagcctgctccacccagagaagcacactttgtgagaaccaatgggaaggagcctgagctgctggaacctattccctatgaattcatggcataataaggtgttaaaaaaaaaaaataaagggacctctgggctacaaaaaaaaaaaaaaaaaactngagcctntagactntgtgagtcgtttacgtanaacc

SEQ ID NO: 3958 - DNA, 743 bp, Homo sapiens
  misc_feature (1)...(743): n = A,T,C or G
agngnnnnnttgatccttnctaatgcttggctcttgttctttttgcaggacccacgattcgaattcggcacgaggtaatttgtaaattctgtggtacttttcaaatgtatatcatttactgagtctgattatcacacggcctggcatataataagtactctataagtattggctgatttctaataggtctgaaaatttatcctttagaattttttcttcagttggtttagcgagtttccctttgatgttgaaaatgtttttttttaaaaatctaacctagaccatcccaaatcatgaattactgttgtgtgaaacagtgagactactgtttttatgccacaggtttataattatgcaaataaatactacatctttgcattcattttggttttacttaccgaattttcattccaggaatgtctgaatctgaacaggctcttaaaggtacttctcagattaaattactctcatctgaagatatagaagggatgcgacttgtatgtaggcttgctagagaagttttggatgttgctgccggcatgattaaccaggtgtaactactgaagaaatagatcacgctgtacacttagcatgtattgcaagaaattgctacccttctcccctgaattattataatttcccaaagtcttgttgtcctcagaccttattgctttaaaatataataatgntttcattacttttattatttggaatgatttagtaaaagttgactgaatctggtt

SEQ ID NO: 3959 - DNA, 743 bp, Homo sapiens
  misc_feature (1)...(743): n = A,T,C or G
agagnnntcntttaatctnantgnactcttatggcttggntactcgttnttnnnnaggcagcccatgngnttccaatncggcacgaggccaaatgcacttttgtgtatccnaagngaaaagangagaggnctcggatgaccatgcttagttaanggggagggtgacctttnatatgcaagtngggaaatncaganaaagtgaaaggggnccanaatgaaaacacatgaaataagataagcaganatgaaangnggcnctagaactgtaagaagcatttgaacaggcanaacagtgctggagactttaggagagggctcaagctgccatgtggccggtcctcaaatagttctagaatgactagcatatctttttacaaaactatnagcaacttgagggcaaaaataaagtntatttatcttgcatccngaanaataaacntggtgctnggcattnggtaggtnnnctttatgngtatatatgaaaagcatattttcattttattagaacattgtggtaaaaattctattgaaaaccatgctntaatgtagatagctcnacttanttcggangttccaaactttttngttcaagtncccatttatgctcctaaaattggtctgccagtctaaaatacttanttnatgtnggtnatgtctatcgatatttaccatttnagaaattaaaactganagatttgaaaccattntttnaaacccttacatgntaacataaaacgtatttt

SEQ ID NO: 3960 - DNA, 726 bp, Homo sapiens
  misc_feature (1)...(726): n = A,T,C or G
cttatcttctaatggcttggctactngttctttttncaggatcccatgcgattcgaattcggcacgaggtgaccaccactccattcttgtctcctgtgttctcggttcagaccacccacaaaggcagcttcaaagccaaatcctcaggaagggggatctgcccgggctagctagtcacgtgtcaggcacagtcagctctgttgaggggtgtgcagtgagggctcagtgaggccacagagctcagatgtggctatgaagactcctggttggtgggggatggcagttctcacagatgagaggtatggatgggctgggtgcaatgactcacgcctatgatcccagccctttgggaggccaaggtgggcagatcacttgaagtcaggagttcgagaccagcctggccaacatggtgaaaccctatctctaccaaaatacaaaaaaattangtgcccatggtggtgggtgcctatattcccagctcccaggagactgagcangagaattgctcaaacccaggagcttgaggttgcagtgagtcaanatcacaccactgcnctncacttgagcgacagaataagactctgngttaacaaaannaaaaaaaaaaactcgagcctctanaactatagtgagtcgtattacgtanatccagacatgataagatncttggtgantttggacaaaccacactagaatgcantgaaaaaaatgcttttatttgggaaa

SEQ ID NO: 3961 - DNA, 747 bp, Homo sapiens
  misc_feature (1)...(747): n = A,T,C or G
agngnnnnnnnnttntcttatntacttaatgcttggctacttgttctttttgcaggctcccatcgattcgaattcggcacgagctgagtctccttatagatgaggcagcagaggccttttacaaatacctctcttgttccagttacacaagtcataatttactgagcacgatggtaaaatcctttaaaaatgtagtaaaaagaacagagtatgcatatgcaaaggaggagattggggaaagcaaattagaagtctatgcattctgtagacagtgaaagctggttcaagcagaatgaataagaaagtaatttaaaaagaaggcatcacttattgactaaggtcaaacaggaggaatacacataaaaaccagaaactaacttcaagcagaatgaataagaaagtaatttaaaaagaaggcatcacttattgactaaggtcaaacaggaggaatacacataaaaaccagaaactaacagcaattatgatgataatattccaaaaaaaatcttgagtgaagaagaagaagaagaagagtaatagcaaacccttgtgataataagtgccaggtgtgtagtatgtgctgctattaaagtaaatggatgttcaattatttaatttataattctggnttcatggatagtcctttaagggaagtgctattttgatgttcatctttacatgtgaagaaccggttaagagagattactgattctccanggtcactcactgatgggtggtggnaattgg

SEQ ID NO: 3962 - DNA, 750 bp, Homo sapiens
  misc_feature (1)...(750): n = A,T,C or G
agngttnccntannaactcntgaaangctgggctacttgttctttntncangnngcccatgcgattcgggaaccaggggctgcagaacctttccctccccaatgaggaccccctctggacgcccctccccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaaaggaacacatttgttctcttacagttgcaggggccanaagagtctaaaaacagtcagcagggctggttcctcctggagcttagaggggctgaatccgtttcctgccttttttagtatctggagggcgcctgcatccccttgcttatggccccttccatcaccaaagccagtagtgtcacatctttcactctccctgacctgactncgcctttctcttagaaggaccctgtgtgactttggactactagataatttagggtcatctcttcatttcaggaacctggaatttaatcccacctgcaagtnccttttgccaggtaaggncacaaattcacanggtcttgaagatgaaagatgttggaccctttttgagggncatgat

SEQ ID NO: 3963 - DNA, 462 bp, Homo sapiens
  misc_feature (1)...(462): n = A,T,C or G
tnttcatctngcnnttggncttntngcacgatccctcgattcgaattcngcacgagacacattcttccatttgtcagtaagagtaataatttgactgttttattggattttagcctttttgatttcatatagctgtatcttaatatatcattgtttttaatatgtctacattgaatacttattacttgtgcaatgaaaaataataattaaagatgaaagttaagcctgttaccactttcagagaacaacgtgacgttttggaatttaaaattttttcagtagatttgagaaaaacttgggttaaaatgaagatttatgctcagaactgagattccagggtttaagtctggttttaaagctgtcttcaagattttaatgtattttctgtgtgtataggatgctctcatttctgtttttaaaaatgaaagggatcgctcctgtaatcccagcactttgggaaga

SEQ ID NO: 3964 - DNA, 828 bp, Homo sapiens
  misc_feature (1)...(828): n = A,T,C or G
ccccctttntatacccntcctnctactngntctttttgcaggatcccatcgattcgctttgtcccaatatttgtgacaccagtgtaatgacttggttaagttgggttgaccaggttcctccactggncaggttatactttttcattctgtaattaatgtatcgctatatattttatatactttgaaactgtaaacatcttgtcctcatcaaaccttcacctactaattttagcagtcattgctaattttttaaactcccattctttctacatttagtagttggcattctactataaggaagaattttccctttttccttatttgtgtatacttatttattaatatttattatttattaatatatatgcaagtatagacacttgcattcttattgtattcagtggattatgatccattgctattttctgtttgggctaaattgtcccatattccatcagtgggaatgccttcaagttaactattgtgtgcctttgacatgtgcccaacatggtgaaacccaatctctactgaaaatacagaaaaattaccttagcatggtggtgtgtgcctgtaattccagctactctgaangctgagtggggagaatcacttgagcctataaggcanangttgcaatgagccnagantagcgctactaccactncanccttgggtgacagcgtgagaacctgtctcaaaaaataaaaaaagaaaagagaaaaaggaaaaaaaaaaaaaaaaaactcnaccctctanaactataggggaggcggtattacgtagatccagacatgattaaganacattgatgagtttgggcnaaccnct

SEQ ID NO: 3965 - DNA, 810 bp, Homo sapiens
  misc_feature (1)...(810): n = A,T,C or G
ttnattccatcagctcttgttctttttgcaggatccctcgattcgaattcggcacgagatagtaaattagtcatagaaaggcaaactcaaataactttgaacacagctctttgactatccacctgtgtgtaaacaaacaaaactacaaagaaattttgtacttcacttagttggtagtgatctggtatagcaattctgaaaatattttctgtgtattgtaggattaaacaaataagtaaatataatgatattcttgggagctgggatcctcactatgagagaagaaagataaaaatatggagtgaaggaaggcaaagaagagctccatgaattggaatgagagattccacagattacttattaattacaaagataaaaaaggaacctttatagtggagaaacttggaaacttggtggataacacaacttttcgtttttttggagacagagtctcactccctcacccaggctggtctcaaactcccgacctcaggcgatccacctcaaagtgctgggattacaggcatgagccctgcgccaggcctatttttaaaaatcagatctctcctttgctccaatgtttttatcatggaaagagacaaatcactcatattttctttttncagacaatactgctttctgtggtgtagcccaaaagactcgtcttttncatgttcaggtaatttattctttgggagagcactgtaatcatatatcaatcgtattttnaaagtgactttattatttaatgtcaagaagtnccttggttntgaaagtagttttttttaattaaaccgccancagatcnat

SEQ ID NO: 3966 - DNA, 857 bp, Homo sapiens
  misc_feature (1)...(857): n = A,T,C or G
ggnnncccttttgaaaccccntaaagctacntgntctttttgcaggatcccatcgattcggaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagtttattttctacaacatgttgctctgtagcacgtgtatttcactactgagtggtagttctaatggacatattcttaacaaaatagtcccagcattacagaatactaggttagaatacatacccaaataaataaaatgttacagacacagtccaagctcgttctctcctgacttnctttctcccgctacagaggaaaattaccccgaattggcacatctcattcctatgcactcttgttaaaaataacttatagtttgcttctgaatttatagaaatgggcactataatccatatgtcttttgaatctttatacatttgatttggagaaagtatttatgtttgatgccatgtggctttaggncatttattttaattttggttatttttttgagatgaaagtctcggtctggcacccaggctnggagtgcaaatgggcacatgggaacctttgncctccntggggttcnaagcaanttctggtcttcatacctgtaantcccancaccttttaaagaaggcccnanggcgnggggaagggatcaatttgngcccccttggaattttggaggaccnagccctggggct

SEQ ID NO: 3967 - DNA, 814 bp, Homo sapiens
  misc_feature (1)...(814): n = A,T,C or G
ttccatcaagctcttgttctttttgcaggatccctcgattcgcttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggatttttgaggaagtggaagctgaactgcagtttgtagaataagtaagagtttagtcaggcaaagcagatagacaaggtcattttgggtggagcgattaatataggcaaagtcatgcaatcatgaaatagcatgatatgtatgtgaaataagagtacttttgcattgtaggggcattaaacaggtgagcagtcactggagatgagattggaatggtgggcagggcctaagtccctgagctgcaatgtcattgaagctgaggacattgagaatttaaagagatagagtgagtctgnggcctttgctcataactctcattttgaaagactaatgtgtgacatnccacattttaggggtaggaaggcntactggaaggattaacccaaagttggntagaaactgggagaaagannaacnccctcaaaaagttgcttgagagctaaattaattgaatgtggcttgggaaggatcaattt

SEQ ID NO: 3968 - DNA, 825 bp, Homo sapiens
  misc_feature (1)...(825): n = A,T,C or G
gattcccatacaagctcttgttctttttgcaggatcccatcgattcgaattcggcacgagggaaaagtaaagagatcaaaatgattttatatgtattttttttgtactcagagaattacattttcactacccccgcctgtctcagggaatagcctttgataagaatcccatggagatctctggaactctattacagtgtgttcagatttgttagttcatatgtaaatttcagagctagagcttcaaaactagagtattgtaatctcaggaacataagattatccaagaagcctgaaccttgctcttttcatgataaatgacatccaaatttcctttgtctaggagataagcatagatcccttttatcatgcttctctgagattttcacagaacaaccctgcaatttgattttgtttgataattttgctttttggcttttcagtgaggactctattttccattggaactgactcctttggggataataagctttcacttaaaagaacattccattagatagttctaacttcaatgaacctaaaagtggcttcttaatttgaataatctggataacttttgcaaatgggtcaaaacagcacaagtattatacatcaaataaaaagttcattacaatatttgtactcataaagtcaaaatctgaccctggttcgctttgtgcctctgtcagcctacttacaggggataaaaggtncacaccaagtccagtggttgccaanggagctttggttattagaaaagaagcctgggtccccctcagttctatgccggtgggggggggcccgggtnggnancatggccgncatg

SEQ ID NO: 3969 - DNA, 877 bp, Homo sapiens
  misc_feature (1)...(877): n = A,T,C or G
ggncntttaaacctttgtacaagcccttgtnctttttgcaggatccctcgattcgaattcggcacgaggcaacaaaagcatacaagatcttttttnaggaagtggaggagctgcagggaccgaccgggagctttcccagtaagcatcagttcanaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtacatcccttttgctcatccagatcttaatgatgccacaacccttacgcaaaagaccactttacctgcattgtgaaggtctttttaccctactgtacacacaggctcttgcagcactctcaagttaaaatgcagccgaagaaaatagggtcagccctgggaaacaccccgggagcctcttcaaaaaagaagtaccattgtggatggccagaaaaagtctttaccgaaagtatttaacttggnggccttttggtggaataaaggtggnaacctatttttaaaaagggaaaagttttttccccntggaaggaaanggnaccttcaggggaatggtggccaatngggtttaacc

SEQ ID NO: 3970 - DNA, 912 bp, Homo sapiens
  misc_feature (1)...(912): n = A,T,C or G
ngncttgnnccttgaaacccccgncntggcggacccatcgantcgaattcggcacgagggtcancaatangcganncttttnnatccnggcgagagacacgccaatagggggnatttaganacgtggggctccannnattttctctggggacaagctcattccttcctcattttctcagaactttggtgttaacagccngttgcctaatttgtaggggctgactttgactnagcagatgccttctgnagatggaggaaataacgacccagcnccttttaattcacccaagctgaaaccaaatgcgaacccngagcagcctggattcattgacgagccagcaccantgaacccacccaaaccaaagccaaatccaaaaccccaagccggcctgaattccaccgggggatgacttttgatctccacaganggnntcttcatggggaacnaaaaacaggggangntgcactcgattnctggaagtggtatgcntcaggagcnaccgtgnantgtantncancccactcntcaaatncataaactntgggagantccttcaattcactgggcaaanccntatgccntaanngctanncnctgangggaggctcntncantgcaaaaanccaaanatccaacctngggaagaattcaagtcaaagacccaanaaggaggccnggcaatcaagnctccttggncaccgaatcnttnacangncanngcttacccnggganggcaccntatggcngaanctctgtggggggcaaaccctcgtggggacctnccntggnttccccagggggtgcncacanatattangcacctnantnntttanctgcccantgngcgtntnttatggaanaaaagnaaatcaaaacatgnggganagggaaacccannaaaaaaaaacc

SEQ ID NO: 3971 - DNA, 816 bp, Homo sapiens
  misc_feature (1)...(816): n = A,T,C or G
ttgattccatcagctcttgttctttttgcaggatcccatcgattcgctacgaccccatcaatttggcctataacttgaaagagaattctatcctgctagctaaagttgctcggagtgaccagtgagattgttccacagcatgtatattataaaacaaatattaggcagatagcttataatgactttttaatatttatttattcatttattttataataagcagacattgggacaagaaacttctgaaaatatttatagttctctgaaagaaggtgtcttcccttccttctgggagttaaggaatgttttgacaaggaagaaagatgggtgaataagagtgtattgtattaataactaacattaattgaatatagaatatgtactaggggctgtaaaaagctctttatattggattatggtatttaatcctcaaccttatgagcctgatgctattaatgcctctattttataaatgaagaaattatgtcacagaaggttaaataatttattcaagggcaacttgccaagtgagcattaaacccccagagtgatcctctccctangtgcagagcaaagttncaaggggcttggtatgcaccagtctcagatgattctattgngggtggctgccagaatcaagcttgctgtgaaaacactgattggaagaaaaaatagtccccaccagctatngctatnggtncctgtgcatgaacctgagaagaaagccaagccgccntaaaagatgtagagtccaaaccttttgctgcagcttccntggaatacgggcatntgcacccaaaacatggnttaaggggg

SEQ ID NO: 3972 - DNA, 817 bp, Homo sapiens
  misc_feature (1)...(817): n = A,T,C or G
attcanatacaagctcttgttctttttgcaggatcccatcgattcgaattcggcacgagaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtangttcacctcctaaatccccaacacatgcctnttcccagcacacacaaacagagaaggactccctctgaaagggacatgcagaacaccttcagtattatctcaacaatcaaaagctaagctaatgtctagttctggtgtgggtagacttgcagatttcaatatatcccaggtcttntacagcnggacaatgtcgntctttcccccaaaaaccatgatttgctgcaataaaaaatncctttntntttccacaagaaaaggtcagctgtcttttttagaattcaccagaatntttcctattccaaatgggaaaggatttttccaanttccatct

SEQ ID NO: 3973 - DNA, 804 bp, Homo sapiens
  misc_feature (1)...(804): n = A,T,C or G
attcnaatcagctcttgttctttttgcaggatcccatcgattcgaattcggcacgagcaaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtcaaagaaatactctgtcaatatagtataactgcttatttcaaattgtatctaggaatgaataactactattatttaaagtactactgaattttgaggaactgatcaaagaattagtattattaataaaattgtactatttgcaatatatttgccttggcacaaatgcagagttaaaaacataaaattataaaaaaaaataatagtgattggttgttactactttaaaatcctactaatttccattagcactaaatcaaacagcacttatctgttgtatacaagtaaaattttgaaagactcngacacaaaatgaaangctttttaaaaatgtctttgccataacanggtatatgaccccttgctaattggtatatttccttangggcactttgaggctctttcaaaagacatctgcgcaattagggcttaaattagaagtagaaatattttggcngatntttactatntcacaaaaaggcctacctactggntttataataaaanccaattctcaagtnttctn

SEQ ID NO: 3974 - DNA, 789 bp, Homo sapiens
  misc_feature (1)...(789): n = A,T,C or G
ttttgaaacccatcanctcttgttctttttgcaggatccctcgattcgtccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggangtcaagcgtaatgtccttctgataaataaagcccttgctgaaggaaaagcacctagatcaccttatggatgtcgcaataatacaaaccagtgtacctctgccttntatcaaganacttgggtgctttgaanataatcctccccttttccccaaatgcagctgaacatttacagtgggttgccttagggattcattcaatatgtttcctactaggaatccaactttaacatttttaatctcaaatattat

SEQ ID NO: 3975 - DNA, 871 bp, Homo sapiens
  misc_feature (1)...(871): n = A,T,C or G
ttcccatacaactacttgttctttttgcaggatcccatcgattcgaattcggcacgaggttgggcttagaagatggggctgagtagggagagagggtgctgcctgggagctgagccatacaagtgactgcacaggttgacatggaggattaggtggagtgaggcttccaagcagggaggggaatgatggtggggcccaaatgaggagccacatcgaagtagatgagagaatagaaggtgaagtaagggctggcgttgggtagggggagacgccagcagtgatgctgatgcccaggctgtaggtgtataggtgccatccacctggtaaagagagagctgtagcgcaggaatgaggttgcacatgtagaagaagggaaggatacaggggagagaagtgtcttctagtcctaaaaaacagcctgtgggctggcatggtggaacaaacctgtaagtcccaacacttcgggaggtcaaggtaagaggatcatctgcttgacccaggagttcaagaacagcctaggcaacatagtaagatcccatncctacagaaaaattaagaaattagcccggatgtcgtggcacacaccttgttgtctcancttacttggggaggcccgatcttttggagccccngggaaggtcaaagtcttccaatgaccnccattgatctttgcccacttggacttttaaaccctggggccaacttgacntgnccaaccattgttntttnaaaaaaaaaaaaannnnnnnnnaacttcgaagccctttttaaaaactttttagtngagttccttatttacccttanatncccaacccttggttnaggatcccatttgattgaattttgggancaaaacccccaacntttgga

SEQ ID NO: 3976 - DNA, 779 bp, Homo sapiens
  misc_feature (1)...(779): n = A,T,C or G
naaanaaaacncttttnaaactacccggtctttttgcaggatcccatcgattcgaattcggcacgaggcctaaagtaactgaagatccatctnttcgtatacgtgcaagtcacaagggatgcgatggcttggcttgggctcagaggcctgacactagttattataaaatgtactttcagcagtcttctgggacttgactaccttgtggattgtactagaaatgtcaggtatggtgactgctctgcccaccactctaaatgaaactgtccccccacagtctctgttgcccaggtgtcctatgtccctcgtcacagctgaatggaccaaggcagatgtgctatcaaggacagccaatcacaagtgagcagtaatctctgatatgctttggtgcaaaaagctgagttgagtcaacagttatttaaatttgtgtgcagtcacttccgtttgctggggaatggcgtggtgagggaagattgatataagttacctcatatctgggttacatggatatatatcctacagttgcttaaaatacatttcangattctttggtttgcagcatgtgttttggaaaggacagggagaggaaattaagaagtggagtgaaatccaaggacccttcacctgcccaaaaagtgacgggcttctggtgtcaancaggtgacagctggcaaggctttgccctganggtcgacagacaaaacaagcantgcacatagggaagacacaagcaaaggttgagctcnttgccatatanagctgcatgnaaaagcttaacn

SEQ ID NO: 3977 - DNA, 1005 bp, Homo sapiens
  misc_feature (1)...(1005): n = A,T,C or G
gatcttctgtcatttgcttttctgagttttggccctcctgtcaatctatctggtcgggtttacttttctncatcttcaagcaggggtgtgtcttcaagcatgcatgtctgtgntttgattcggaattgataagttataatagaagcatgagctgctgggaaaatatacctcctgatttgtgtggntttatttgttcatcttgcaggttttgagtagtttttggtggatgtgttgggagatttnaatgttacttanctggtattatctctactactttgggggtcaatattgaattttttcactgaatcccagcccaacactntntttttttttggcnctaattncntcgaaaaaaaatggngtttggatttaagaataaagangaaaagtnntggtttttttagccagggttcttgtcctancaggaaaaaggcttttggttccttaagaaaccccatanccaatttggggaaatttttaaaatttnaaatncaaaaaggccctttatatttattgggaaaaccatccttggccttaataattnaattccnggcnaaatcctgggaaaatgggaaaaagtttaggaattggaaaaaaaaaaaaagnacccnccgggntncccaaccaaataaaaatacccccnccccaaaaaaaccanggccatagaccccacctctggnaaatttcnaaaangggggcctttaattaataangggggggnaaaaaanatttttcagnccctnttggaaacccntttgggggnggcccggnatttaccngtnanaaatncccccanccttggaattaaggaatncatttngggtggananttngggnccaaaacccccnaacttnggaaatgccaaaggggnaaaaaaaaangcctttaatttgnggnaaaaattgggggagnccaattggctttaatttgggnaaccntttataaagcccgcanttaaaacaaggttaacncnccccccaatngccattccatttaaaggntcc

SEQ ID NO: 3978 - DNA, 790 bp, Homo sapiens
  misc_feature (1)...(790): n = A,T,C or G
tttnnnnnnnnttnnnnnnnttttgaatntgaaanccttnanacaagctacttgttctttttgcaggatcccatcgattcgaattcggcacgagatataaaagcgtttagaanaagaagcaaaagagacccgcacattccacccagggagggcatggagaaagaacagtgagtggaaggaaaacaggtctgtgctgcctcaagcatagaggtctttctatggcaggcacccggggcagccaaaaggacactgtccacagccaggccagagtctanctgtnacacacatangcaggtgtgttgcatacctcaagcatgcgttcacgagttgtnatacttaagngaatttgtttttttacagnaacaacctatagttccatttaaaaagggatngttatttaattttaattaaaacatatagtagntgtttnctcactttggtttatgtatccattttcaacagctttgttgaggtgttgtttacacaccctcaaattcactngttttaagcatacaatntaataatttttagtaaattcagaattgcgcaaacatcacaatctantaatagaaattttctttcactccaaaagaaacctgtgctctatttagcaactccctgttcccgcccagtaagcccatatgtgggcaaaagttgactganacttgtgatttttaattgaaatatcacaaaacttattgcattttttttttgagacggagtcttgctctgtcgnccccagntgnggggaaggggctncntncccccnnctnngngnnnggnggnccnt

SEQ ID NO: 3979 - DNA, 462 bp, Homo sapiens
taacatcagctcttgttctttttgcaggatccctcgattcgaattcggcacgagcctagacacctcgtattggggaaagtcttaagtggttggagcccatgacatttgggtatgatgactagattttttgtacagctgagcctcaataaactcatgcgtacacttgtgagaactcaaatcagaaatgggcacagaaactggattacatttctgtgctctgaaatcccacagagttcataaaaatacacatgtatacacaaaagcaacaaatgtaagttacattttattatggaaattgatattagtgaaattgacagctttctatggttaaagattatcctgtaggtgagccaaggttctctgtttttctgatttctcttattcattccctataatttcagcattttcgttctcattgacttaatattcctgagggtattattgtgaatgtctttgtttatg

SEQ ID NO: 3980 - DNA, 475 bp, Homo sapiens
  misc_feature (1)...(475): n = A,T,C or G
acntngatcaagctacttgttctttttgcaggatcccatcgattcgaattcggcacgagatctttaaagaaagcatccacagtttctgtgccatttcattgacaggttttattttaaatggtagaccatccaacagagggatagggagctgcagcggtgtgctgcttagactcaaaaagagaantctcgctgactcatgcaggttgaggttttgtctcattcccaggaatgcttggactcccagaggcagtgaagccacacattttagcagaattacctcagcagtgtggtgcatgatcatgaacttcaagtttacctacaaggaagatttcattgtccttctgtcactagccaaacacttcacagcctanactcctggactacataaaggcccatacaaaagtgtttgtgtgcatttgtgtatgtgtgagtgtgtgtgtttgcagtgggagaggacacttatctttgctctccc

SEQ ID NO: 3981 - DNA, 460 bp, Homo sapiens
  misc_feature (1)...(460): n = A,T,C or G
ttcattactcttgttctttttgcaggatccctcgattcgaattcggcacgaggcggagcttgcagtgagcagagatcgcaccactgcactccagcctgggtgacagagcgagactcctctcgaaacaaacacaaaaaaaagtttcaaagacagaaagtggaagttacaaggctttttaaggccttatcttggaagtcacagcancatttattttgcattccattggtcaaactcaagtcctaacaggcctaagggggtcaagtaaaaggtgggactcacaggaagttccatatacattacagcttcacttgcagtacagaggggaagggaaatcctactgggacagaacctcaagtagcatacctggttgtatattgtgcctggaagaaaagatggccagaagtatagatctatagatggatggtgattgatggatggtttgactggatggtcagggatt

SEQ ID NO: 3982 - DNA, 463 bp, Homo sapiens
  misc_feature (1)...(463): n = A,T,C or G
cttcgtttgantcccgttccaangcaggagcccatcgattcgaattcggcacgagactttgcatttgctcgttttgttcaacttttccttccttctctgcctgccaaagaaactgtaataactgtaataattnttatgactttctcttcaatgacagtnatcttcctttaccctaattccttccctcctcatccttcaaatccccttcctcatcattcaaagnctaactcaagctagcctttcctccttattttccccttatctttccaatccgtatggagatttctcacctttcctgntngaggttgcgccagaatggcgaggattaaattgtaattgctntntaatagactgntgtgtcngcccactagatttcaagctctctaaaggtnaaagctntttctnacatcanaactngagtcctttatggannntnncacatcngaaggncnnnanttatttg

SEQ ID NO: 3983 - DNA, 457 bp, Homo sapiens
  misc_feature (1)...(457): n = A,T,C or G
tattcatcaactacttgttctttttgcaggatccctcgattcgaattcggcacgagtctagctcagggtctctcatgaggtttcagttatgatgttggcttgtactgtgtcgtctgaagcctggctggctgaagcatctgcttccaactcactcatgtggccatttcccagagcccagtccttactggctttttgccagggaggccttaatttcttacatatgggcctctccatagggcagcatgcactttgcagctggtctnccttacagtgaatgatccaagagagtatgagagagtgtgccacaatggaagccaggtatctgttataacctcatcttagaaatgatataacatcactctgccatattttgtcagttgcacagacccctggtacagtgtgggangtgacaacacaggatattaataccaggangcaggaatcattgggaccgtct

SEQ ID NO: 3984 - DNA, 465 bp, Homo sapiens
  misc_feature (1)...(465): n = A,T,C or G
ttccatttagctacttgttctttttgcaggatcccatcgattcgctacgatgaccccctcttcaggctgccatttggtagagggnnagggagtggctagccatcgagtnagaccatgctttgcacccaccatcagcaaggctcaagatagtgcctggcgtgctcagaataagccttcccttctgcagggatctcatctccatctgtgggaaccaggtntgaggctctgaacagntcctgctctggcaagacacctccacatctttctccctcaaacattcatagcctctctgccattttatgcttctggtacaccagaaataatatcacaatgccctgcatcactgacccggctggataattccttttcaatatgtcctncttgcangcanaagatcttgccanaagactgagaacccagncttccaagatggccacagctgcaccaaagatcacaangtaattg

SEQ ID NO: 3985 - DNA, 463 bp, Homo sapiens
  misc_feature (1)...(463): n = A,T,C or G
attcatcagctcttgttctttttgcaggatcccatcgattcgaattcggcncgagattccagcatccatcacagataacagacagcactattcatgaaatcccaacaanaacacacgccaagttcccatatacaggtgcanggcatgcttcatttaccattgaatttgatgacagtaccccatggaaggtnactattagagaccatgtgacanagtttacttctgatcancgccacnagtccaanaagncttctcctggaactcaagacttgctggggattcaaacangaatgatggcacccgaanacaaanttnctgactggctagcacaaaacaaccctcctcaaatgctatgggaaagaacagaanatgattctaaangcattaaaagtgatgttncagtgtacttgaaaaggttgaaaggaaatnaacatgatgatggtacgcaaagtgattcanagac

SEQ ID NO: 3986 - DNA, 464 bp, Homo sapiens
cgtcattcagctcttgttctttttgcaggatcccatcgattcgaattcggcacgagatcatctagaatcccagcagtttccttaagttgcctactgtcaattttccatttctctcgtccaaattcacatggagacatcatttttacacacttgtaatcaattgtaggcggagtctgggggtcctagcacttcccctaacatcatctcatgatacttagacttttaaagaacccttgagtaggccctgtgataaaggatgttagtgaaaaaaataatgagaaacagggacttggcttagagaaagaagcctgcgtcagatcagtaggcccccctggggctgtggaagcatgcagaaggtcccttaggaagtgatgttggaaatggccttgggccagccacgttatttctctggacctcaggtcacccatctctgaaatgggagcattgaactggctgatccctga

SEQ ID NO: 3987 - DNA, 458 bp, Homo sapiens
  misc_feature (1)...(458): n = A,T,C or G
nccttcntctcttgttctttttgcaggatccctcgattcgaattcggcacgagggaaaacggaaaaaactcaagagtganaactaagtggtgtgtgaaaatgtcattgtgcctgggtggttgaagtcattaaatcagagagccaaaantncctancagagtggancgaaaaangaccggncagacagtgngaataatatatcactgatgtaaaancaactcatatgatgcttgtaaatgtggaaactataactntccctggaggggtatanagatgagttcaattaggagggaaactgagtgacaggaggacaaaattggaagggagatttttactgtataactttgtatcttttaaattttgttccaggcgcatttatcatgtattcaatgcatttaaacagaagaggagaaggacggcccatangatataactattggttaaaaccatcttgtctn

SEQ ID NO: 3988 - DNA, 457 bp, Homo sapiens
  misc_feature (1)...(457): n = A,T,C or G
gnaanncctttncccnnnnnttttgcaggatcccatcgattcgaattcggcacgaggcaatatgtagtttgccataaaangaatgcatgtcttattcttttccatagttcttcattaatgagacttgtagccaagaatagaattggaagatnccatctcctggggtagtcaaaaaaaatctccttgggtaatactggaancanctaattttcctaatttggttggtccctcttaataataaaatnctatgggaatnactctttagtagttggcctggttggaagctctgggaggagcaaagcancctctccaggtgactggctgactttccacctgaaggagtattactgcaagaattacaaagcaggtaggactctggcttttgatgagcaaatggntgaaaagtgcctccttcccagtcttccttttgccttcattttagtttaaagcttgaagt

SEQ ID NO: 3989 - DNA, 471 bp, Homo sapiens
  misc_feature (1)...(471): n = A,T,C or G
aagnnacttntttgaaacccccngntctttttgcaggatcccatcgattcgggcacatcttctactagctaacttggtccttttttttnaaaaaataaaacccttgcgtagttctccctcaggggatgcctaggattttggatgagaacgtattggctcaatgtgagtggggcagtggcaggcatccatttcccttccccccattctgncacaggtgcccatctgcctggcagtanaatccantgctcatgttggtgactccagagccccttccttgctggtgcctgcctgangcattggtgtatgtggcgtcctgggaaggggattttagttnaatgaatgatacgtacctcttgctttcctgggntntgcgagctttaatcccttgatngtctgntgggaggcttganagacanactgggaactgtgtnagaaagcatgactcgtatnncgattgnanngaaatnanct

SEQ ID NO: 3990 - DNA, 466 bp, Homo sapiens
  misc_feature (1)...(466): n = A,T,C or G
tgnttngantcagctcttgttctttttgcaggatcccatccgattcggaataagtgaattggaagatagctacacagaatgaagcatagaagggaagagatggaaatacacagagctagagggtaacacattgatgctacagacagaacacctaacatacttctggagttctgtaagattagaggagagaaaatagagcaagagaaatgttgcaaggatttttccaaaaggtataaaatgtatccctgaatatatttttagtaatctcaacttcaggcatgataactaaaaccaaattaacataaaataatacaggacgcaaaagaccaatagaaaatctgaaaagtagctagaggtagaagatagagtatgttgaaaagaactgtattctaaatacaacctgattttaacagaaaacatggaagcaggaattcaatggattaatgggaatcatgtcttcaatgtg

SEQ ID NO: 3991 - DNA, 778 bp, Homo sapiens
  misc_feature (1)...(778): n = A,T,C or G
ggngnntnnnccctttgaancccttaatacaagctacttgttctttttgcaggatcccatcgattcgacagggtagtgcatgtgacggtgtccaagacgcacagcagattttcattcacaaaaaaatctgaccacaagagctaaacggaaataccttccgctgtccttcccaagtcacagagcaaacacctcagttcccaggggtccgcatcagttctggtggaggcggtgactgtgagcgtgaccagctgggctaattcgtcctgacatttagttgggacagctatagtttcctacctctatgaccagagagtgaagcgtttcactgaagaactgtggccggcgtctccaggaaaggaaggagcctcgctttctccagggcaggggcagcgtggggcggggcaggccgggtgtgtctgtggggagtgggcgcgtgctcacactctttaagctgcgactgcttcctttaggacagaatgaagttcttcgaggaggccgatgaagacagaatatggataaggccaaacctacacaaaatccttctacatcttcatatcaaaacatgttaaacataaacctncaaatacctacagggatacaagcacagggcttnctaaacaggcgggatatgcaacctcgttctatcccangcccacacagaaagtgttgggggaatcactgaaggaaggangagaaagaactcagaagaaccataagagagcaagacatggacaggaaaccaatggcccacgccccgcangaagacttaaaactncag

SEQ ID NO: 3992 - DNA, 905 bp, Homo sapiens
  misc_feature (1)...(905): n = A,T,C or G
ttattccatcaagctcttgttctttttgcaggatcccatcgattcgcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctaaaaaacccannnnaannnnnnnnnnnnnnnnnnnnnnnnnncctcggagagagaaaanaacctttctccgagccctntanaacctataggggagtccgtnttaccgtagaatccccnacnttgaataaagaatnccatttgggttgaagttttngggaccaaaaccccccaaacntnngaaattgccnnntggaaaaaaaaaatgcctttttnttttggnggnaaaaattttgggggaaaggcctttttnggctttttanttttgngaaancccctttttttaaagcctggccnaattaaaacccaaggttttaacccaanccaancccaatttggccnttttccanttttttnt

SEQ ID NO: 3993 - DNA, 790 bp, Homo sapiens
  misc_feature (1)...(790): n = A,T,C or G
gaancccttttgaaaancttanatacaagctacttgttctttttgcaggatcccatcgattcgaattcggcacgagatattattttaattttatataatagcatgtactgctttacacatttttataataagtcaccacagtattacactataactacgttataagtgcaatagatatgggtncaataaataaaaatagttgaggagaaaaaacctttagaccattcattataacgtgccanactgataaggggaaaaccccccatgtcacatgagagaaataaaacccactgccatttctctgtgcctgggtaactgagttgattgtattcaccagaaggttcttgttctgccttttagacctgcctgggtcatttccctgttcacaccccagtgactaagctgaagagatttatcatgatgcctgctcttttctgttggccttggtcacttccatgtgcatgagcatctccatccaaaagtggccttcttctctagccccgatgggatgtcagtngcccatgtttctaatagaagacccatgccaaagccactttgacaactctccactcgcaagaatgctgtcggcctntagctaaactgttatggtccactcaacgctgtacactgtgtggccactttccttccgctttctgtcattgcagggangttgtaaggcaacacccanggggcttgacctcttcaaggactttgccagcancaaaaacccaancttgggtacaccctggcttaaaaacccacanccccagcaanttncnagctttnaatg

SEQ ID NO: 3994 - DNA, 898 bp, Homo sapiens
  misc_feature (1)...(898): n = A,T,C or G
tttaattncaatacagctacttgttctttttgcaggatcccatcgattcgaattcggcacgaggacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcaccactgaaaaatctcgttgttttaaagtncaatttgtaaatatttcaaaaaanannaatnnnttnnnnnnnnctcggagcctctnnaacctttagtggagtccgtatttaccgtagnatcccnaaaccatggattaagaataccatttgggttggaagttttngggccaaaacccncaaacctttggaaatgccctngggaaaaaaaaaaaaggccttttaatttttngggggaaaaaattttgggggaatggcctattttggcttttttaanttttgggttaaacccccttttntntaagggcctgngcnaan

SEQ ID NO: 3995 - DNA, 833 bp, Homo sapiens
  misc_feature (1)...(833): n = A,T,C or G
gncnntttnataccatcanctcttgttctttttgcaggatccctcgattcgaattcggcacgagaatggatgaatttttgtttgggttgaagaatctctctgagaagttgacacgtgggggcaatggtttgtttctcttgtatttctgaagttgcaaataatcatgtaagcagttcaaccaggagtttacaccaaacttttaataggcgatatatcattattttttttcccattggtttggataacatccactttaactggcagttagtcatacttagctatttttgttaaagcaggtgatttattgttattttatatttatgacatgattaataagtgaatatggaagattttacattgacttaggggatcaaagttttcattatattaacacctttaattgccatgagttttctatttctagcatgcatattttgtgttcattcaagtgaagaaaacagtcttttgtgttctcaggtactgcataagccgaccacagtataagacttcttgtggcatctcttcattaatttcttgttggaatttcttatacagcacaatgggagctggaaaccttcccctattacccaagaagaagctttacatattctgggctttcaacctccatttgaagatattaaggtttggtcctttcacggggaatcaacacttatgangntggtttaagacaaattaaatgacccctttccatgtnaaaaaggatgctcttatggttctatattaaaccctcattggggaagaataaaaaccaccagggagaaaacctgcttcanggggnccctgtcnaaagttaaccccgngggtttggaaan

SEQ ID NO: 3996 - DNA, 838 bp, Homo sapiens
  misc_feature (1)...(838): n = A,T,C or G
atncngttttaattccatacaagctacttgttctttttgcaggatcccatcgattcgaattcggcacgaggagaagcagagggacaaggtgtcatccaagtgacctacctgcctcagcctcccaaagtgctgggactacaggcatgagccactgtgcccggcctgttattgttgtgttgtcctgcttttatggtgcttctttttctttatttgtaatagtttcccctcccactcccactgttttcttaacatggagaaactttttttttaattgttcccagtgaatgctgtctcttcccatgttgactccattcacttgccatgaattgacttagtgccagacctctgtgccttcttcatgtaaccagctcaccttagccttcttgtagagggcttatgatcttagttggattaagttaacaagtttttgttcagaaattggaaaatactagtcaccattactttcatctgtacttgaaaatttcgtctctcagacatccatcatctctaggtgttggtgacaangcttgacatctttctaacagttgactttggcttcttaaattccttgaactaattgagagttttcttaagcagagcttanaaggagtacttgcagcccccaaaacaaangcaggtttttaaaattattggnctataagtctttggttattccagctgtcacccaaaatggggattttangcatttacaatcggtaaaagggcaaaaccccaaattaggggatggacaaaatccctcactggnggatgactctttaatgcttaccctcaagactttnttaagagtgnggattatcaaccagngacttcattggcn

SEQ ID NO: 3997 - DNA, 777 bp, Homo sapiens
  misc_feature (1)...(777): n = A,T,C or G
tgaaaccttttgaaacctttnanacaagctacttgttctttttgcagggatcccatcgattcggtaaaaaccctctgatgcaaaaaaaagtattaactttcacaagctgtttgtactcaaatacattttctcagtttcagatcctctgctgttttattgagtggaaagttgagctaaaacggttcaagaagaataatgttgcatttccttatgtctcaggaaacactttttatggtaacttgtcagattgtctatgaacaaacccacttttttagacattgataaagtcttcttttcttcacgtgatattttatacaagagcacttcagatgtattagatgtgactgattttaacaaatcctattagatttgtatcaactagttacatgttctattcacagtcttttgtgaatcattgcctttttgtttgaaaagatggcctcttttgagcctttgtttggatacattcctgtttttgtgacaaaagaaaaactttaaaattgtcccaagcagaaaaataatggctatcagaagtatgttttgtttcagtgtgagttactgttactgtatttgtttattgtaaacgtagacatttagcattcactgcagttttcaataaaaagtaattaaaatttgttgagttctgaaattcaagtacatctcactaatgtaaaagttctctacttgagatgtttaaggcaagtgcgttgtcaattaccaatttccaactcttgttctacagggtctatctgcctattcataccagactcaagaatg

SEQ ID NO: 3998 - DNA, 772 bp, Homo sapiens
  misc_feature (1)...(772): n = A,T,C or G
tgaaccntttaaaccnttttgaaatccnttnggcttctgcaggatcccatcgattcggctatgtgctgacaaatgtggcctactttacnaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccactttgttttccttcacatgcctcttcatggttgccctttccctctattcggacccatttagtacanggattggcttcgtcatcactctgactggagtccctgcgtattatctctttattatatgggacaagaaacccangtggtttagaataatgtcagagaaaataaccccgaacattacaaataatactggaagttgtccagaagaagataattatgaactaatggacttgagacttggcaatctgccaaggggagacacaaaatan

SEQ ID NO: 3999 - DNA, 801 bp, Homo sapiens
  misc_feature (1)...(801): n = A,T,C or G
tttaaaccttttgaaaccctttttaaaaccctttaaacaagctacttgttctttttgcaggatcccatcgattcgaattcggcacnagtaacagtcctatattgtttcctgggcaagttaaatagtcctaattggccctgagttgttagagaatgtttgtgaaccactcacacagaccttgacagataggtttttgttttttgcttttttgaagtacatgatatagacaggaacacagatttttaaatggtagctgttactaagtgtgggagagagctttgactctggcagtttgggatggcctttcaaaattgacaagtgtggttgtaagggttagagagtaagttggtgatgaatgatacactactctttggagaataaagagccaggtgtgagggtagagtgttctangattaggagacttggatgtgtttgaaacctgaggagtaagaaattggtggagagaagggactctgagaggatgccacagtattggctacagctttttcatcttccccaattatccagtaaaagcagagctccctttaatattgggagcaatattaatatgtttactcttatcacttgtatttatcattgnattagangtcctaacaagtacaattaggcaagaaaaagaaatgtttccagnttaacaagaggaaataaaacttttgtggtttgcaggtggaaatgaaaaatcctaaggactcttgtagaaaaaactntntttgaaaattnccanaacagcccaataatnttttgatngggaaaanaaaaacaanaatgggttttattggt

SEQ ID NO: 4000 - DNA, 777 bp, Homo sapiens
  misc_feature (1)...(777): n = A,T,C or G
agnaancnnnttnttannnntttgaaancttntaaacaagctacttgttctttttgcaggacccatcgattcgaattcggcacgaggtcttcactctgcgacaacaagcttcttgaaggcaaagaccatattttaagtatcttttgtgtcctagatgcactgagtaaaannccagggatgccgcagatcataaattngtgntaatnttcaaaaatagactctaaaatttanatttacanaaacattgnaaagatactgnanagttnctgctatcctacactgtttcccatattattaacgncttacatccctgtgatcatttgtctgnattaataaaccagtattgatacattatcacagagaccatactttatnaggtttccacaggntttttccttaatgttctttcactatcccaggatcccatncacaataccacattacatttagtaattatgtctccttagctcctcttggttgtgacaatttctcagactttccctgtatttagtgaccttggcagttttgaacattactggtcaggttntgtttgtttgtttttttgagacaggatctccctctgtcaccaagactggagtgcagtggaacgatctcatctcactgcagcctcaacactctggggtcaagtgatcctntgacctcaatgtccggagaanctgggcccaganatgtgtgccatcatgctctctaaaaatacaaaaaaataacccggcgtgatggtggggcctgtatcccagctactcnggagntgaggga

SEQ ID NO: 4001 - DNA, 787 bp, Homo sapiens
  misc_feature (1)...(787): n = A,T,C or G
ttgaaaccttttnnnnncccttttnaanttgtagaatacaagctacttgttctttttgcaggatcccatcgattcgaattcggcacgagacactgttctaaaggtgttgtgtgaattttcttttttatttattaccacaatctgtgaacaaatacaaatatctttccagttagtgcattccctcaaattgaacttctggctgcaaggaaagctaggaatgattatggttttgttagtaaggaaaattatcaaaatgggatattaggttggctactagcagtcttggcctcatgctttcagtaaatagtgtgcacttcagatcatgtggcattggagaaaggaagaacatgttaataatataacatgggttaggtcatggagtcttgattattgtttcctaatggtactgtttgacttcataggctacaagacaaatttcttcaagtgtaaatttttcgattgaagaagacataaagcctttgagaatttactgtatactcagcactttgcccgggtgtaggataaggatcaaaatcatgaaagcctaatttctttccccagagacttatgaatgtggctgaaaagaaaaagtacaacacatgcaaaataattatgaaataatgatgtatgacaggaatgcagagaagggagagatcagtgtgcatgaattaatgagaaaaacctcatggagaaggagcagcataggttagatcttaaggaatgggaaatattgcagcanatgaaaangactgccagggtaggttataatatagtagnggaagaaaaa

SEQ ID NO: 4002 - DNA, 780 bp, Homo sapiens
  misc_feature (1)...(780): n = A,T,C or G
aanccnnnnnnnnnncntttgaantcatagaaacaagctacttgttctttttgcaggatcccatcgattcgaattcggcacgagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctangttttgcaggcatgaaatagtgattatatctgtggaaaagcatangaaggcattctcctttttcatttttttcct

SEQ ID NO: 4003 - DNA, 797 bp, Homo sapiens
  misc_feature (1)...(797): n = A,T,C or G
tttgaaccctttnaancccttttgaaaatgnaaanacaagctacttgttctttttgcaggatcccatcgattcgaattcggcacgagtttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctcttggctttctattttactgtcttttgttgccatcagctgtatgccccttaattttttctagtaataccttggaatttaaaaatgaaattacaaatgtttatgttttagtgtttttaaaaataattcgattaagtatgctatgatagaggagcaaagttgttattagtaatatcaatgtgcttacaacttatggaaatgaaaaatagtctttagtcctagcagcctttctgctgtagtaaaatagtttgtgcactttaaatcgctgtgaggttacatcttcaaaggactgagtggcataagccagggaggtcttagaaatcttacaaaaggaaaaaaataagaaattattcctcatcatatgaaaattatttactaacaatgtatgatggtttaancttcttttaaattcttcactttccactcctttttgcttctttccttttagttggactattaccggagttaccttacactaatgttgangtatttggggttcanaagaaaaataggccaagtaaanggaaaattggaaaatagtttccaat

SEQ ID NO: 4004 - DNA, 816 bp, Homo sapiens
  misc_feature (1)...(816): n = A,T,C or G
gnnnnnnnggnnnnnnnnntttnnnnnnttaatgaaccctttgaancccntntgaaaanccntngaaacaanctacttgttctttttgcaggatcccatcgattcgcactgtggagtccctgcaagtcagcaggaccagggctgtcttcctgcaccatctggatttggttagctctctctgggcagtggggccgagtctcatttcctccaacaataatgttatataggcaatgatcctgggctgccctaacataattgaaaattatgtgtattgtaggcttggagtgctgaaatgtgggctcataaaaatatgtggtgcaggtagcctatggagattggatgtggcacacaatgaactttatgtaaagtaagaactataagtctccatgttaatattgtattatgagtatgacagttcttgggtgggtcctcagggcaggtctgtcaccttcaacaaagcccgagtttcctaattctacagagctggtatttggatgtaatcaaatcggttttgcaggtggccaaagatgaaaacttgtccaccaatccagctctccccactgagggatagcatgggatgtagatgggtttgactccatttggcatttttgttcacggntttttatgagatggagaggtgagtgttggtgggtgtccattttggttggcctcaaggaaatgactctattgagtggttttgaccaatgcactcatatagttatgtggtaagtgaaggatgggggtcctgtacacaaccacccactagttctnttctccaccaaaaaggaataaaagttttgctttcattctcaaaaa

SEQ ID NO: 4005 - DNA, 786 bp, Homo sapiens
  misc_feature (1)...(786): n = A,T,C or G
ttnnnnccnttnnnnnnnntttgaatttctttantacaagctacttgttctttttgcaggatcccatcgattcgaattcggcacgaggctggaggctgtcagaaggatgctgggggtgaagacaccctggggtcctgacaaccattgggagtgtctggtgctcctgggtgagagagagggccagttggaaaagcctgcaggcccagccctggggcagaactgagtgtggcgggtgctgggcacaggatattcccccaggggcttagcttcatgcattcaggcttaccttgaggctccaagcttattggtggcataagctctgcagatccctcacctgccatcagcctcatctgaatctttgtctttcctcagataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctangcttgtcaagaatctgttcagtccctctccttctcaataaaagcatcttcaagcttaaaaaaaaaaaaaaaaaaaactcgagcctntaaaactatagtgagtcgtattacgtagatccaacatgataanaacattgatgaatttggaca

SEQ ID NO: 4006 - DNA, 825 bp, Homo sapiens
  misc_feature (1)...(825): n = A,T,C or G
attccatcagctcttgttctttttgcaggatcccatcgattcgaattcggcacgaggggaattcgaccaacatggagaaaccccgtctctactgaaaatacaaaatagccgggcgtggtggcatgaactaccacactcggcagcatattttaaaatgcagttatttctgaaagtttttggttttacacaattttttttttaggtaataagatgtattgtaaggattatgcttacgtatggtacagagtatacttcacattgttcctgtcttttttgtgggggagggaatgaccgaaagcattgggaatgttaaaggcaaatgagtaaaaagaaaactaaaaaacgattacttcttcaaataatgaggaaagcgtttttaaaatttttgtctgtttttaaaaagcaagtttcatgttagatttcttaccacactcaattatttcctaatataaaatagatataaaatttgtgatttgttactttttatgtaagcatatatagtccagtctaaaatgaccaacttccaaatgtgttccagaaaagaatcatgacattttatagctgaaaaggacctaaaaatccagtccttttaatataacatatggtaactgactccttgggagtataaaattaattatttaagaaccaggtaagatagtagccagagcctagaaccaatnactcagatgccccttatccattctaatattccacagcattttctagaaacctcacttaangcanttaatgtggatagggttttacctcnaaaatagtcaancccccaaatgtagccaaatacctaaggnggccttttttgnttcn

SEQ ID NO: 4007 - DNA, 787 bp, Homo sapiens
  misc_feature (1)...(787): n = A,T,C or G
ttagnnnnngtttaancccttttgaantttttanaanacaagctacttgttctttttgcaggatcccatcgattcgaattcggcacgagggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccanctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccanccacagcaacattgtcacacttccctctaaaaatggttttccagntcagatgcaacagggatacatttgttctctgttgtatgagaaactgacaccaaggggatcttaacaaattcctgaacaatggcttcaaaaaaggatatttttaaaaaccagatcttgtgagtacaagccctaatgtgcanggacagggtcatcctgtatattcgttctttactcaaactctttcttggttccttcattangaagcatgaatggttgaatgtgaac

SEQ ID NO: 4008 - DNA, 464 bp, Homo sapiens
  misc_feature (1)...(464): n = A,T,C or G
tattcnatncagctcttgttctttttgcaggatccctcgattcgaattcggcacgagagtacgagagcaaagaatgcccagagatgacactagtgatttcttgaaaaactcattattggaatctgatagtggcttttattggggcttacggtgagacatatcctgccattgaagatgacgtcctccctccaccatcacagttgccctctgcacgggagcgcaggangaacaaatggaaaggactagacattgatagcagtcgtnctaatgtagcaccagatggtctctctctaaaatctatatccagtgtaaatgttgatgagcttagagtgagaaaatgaggaacgaatgcgaagactgaatgaatntcacaataaacctattaatacagatgatgagagttcactggttgaccctgatgacatcatgaaacacataggggatgacggatcaaactctgtagc

SEQ ID NO: 4009 - DNA, 766 bp, Homo sapiens
  misc_feature (1)...(766): n = A,T,C or G
tttgaaacctttgatacaagctacttgttctttttgcaggatcccatcgattcgaattcggcacgagatgcctagtggtctctgagtgtaggattcttgaacctgctgatttgcatttcacctgtagttctacagtaaaaaatgattttatataacttttggtatataagtctcaaaaagtgtgagtcagaagagatgaaacattatatttaaaatttcatatcaaagcttctaatacaacgttgctagagccatggcttggaaataaatcaggaaaaaaccctcaaatacagaatcagttgtgttaatgcactagaacttgccttctgctttaaagccataattaatcatttaaatgctggataaaaaccatgtgttttgtctttagaaaaggtgttgagtggacttcaaggtttagatctgtgctgtcccatacagcagccactagtcactagcgggcctggctattgagcacgtaatatgtggctattgagatgtgctctaattatcaaatacacaccaggattcaaagacctantacaaaaaaagaatataaaatatctcaaaaatattattgtattgattacattttaaatgataatggttgggacatattgggttaataaaacacatctctnaataaactttttaaaaaaaacttttcaaaatgcatctatgaaaacatttgaaantatatattatggcttctgcttacgacttggatcatgtttatgttgggccacatagtttaaatcntttatatctn

SEQ ID NO: 4010 - DNA, 784 bp, Homo sapiens
  misc_feature (1)...(784): n = A,T,C or G
ttgaancnntttanncccttttgaaanctttatacaagctacttgttctttttgcaggatcccatcgattcgaattcggcacgagaagacacttcctctccggaaagccagtcatattcatcccagcgtctttcttggtgtctgtgcatggataaagcctccccattcccccgtgccccccaccactttgtgtcctttcactttgcttcacttatgtgcccaccactccagggctccctgaggtccaggaattccatgccattccctttcacatggctgagagccccagccctgtggatgagctgtcctgagtgggcactcagtaatgtgggcgtaactgaaccaagctgaagagggaaggagcaaaaaacaaccagaagccctcagattcagagtcatgtcgttaaacactttttaaaataaaaaattagctgtgcaaactgaaatcaatttaaactattttctttgactaggcaggaaagaggaggctgctacatattaagaactcccacttaagccaaaccttcatgtttccaatctccaagcaggcattgagggcctctgggctgcgtgtgggagagccaggaagaaagaagagtaggccctgcctttaaggtccttcctgcctaaagcaatctataggcagctgtgttctaacaaaaacttttatttataaaacangcagccagccagcctgcctatgggcagtagtttgccaacctgtgctgtaaattaaaagaagcttaagagatctgtcagatagtgataatgtatgcacattatt

SEQ ID NO: 4011 - DNA, 781 bp, Homo sapiens
  misc_feature (1)...(781): n = A,T,C or G
tttnannnntttannncnntttgaaanctttatacaagctacttgttctttttgcaggatcccatcgattcgctcagccaccgtctccttacctgactcctctgggaaagagtttccctaggttaagccatacagggatagggtaggagatgccatttggatctaggagcagagggcagagcctcagcaggaagagtgtctctttgagaaggagacacagtggagcaggtgtgtaggttcacagggccagctatgggtagagtcgggtgtacatttttagaagccacaattcccaaaaatctcctgactataacatcagtgcacagagccagtcaaatggaggaggagtgggtccaggcaattcaggaagaaggaaagtaacaaatgagtggttgcaggaggacactttttctgtcgaggtcactaaacaaaacattgtctcctccccttaacttcagaaacaatggagggtaaaagtgtcgcctgggccctgggggcaaagacggtagataacttctctgtcgtgttctccagaagggcccaacaattacaaggttctacggttctaaattccaatctagtcttccacatcattttgaaggtataatattacttgtcaaagtgggatgatagaagatatgtgtggacataaattgttgtcaaggaaaaaaacttaaataagaaaataagagaaaaaatntntgtatgtacagtggttactagaaatatgccttttaaatatttggcatgtggattgtggcctcatcntcactcagtgnga

SEQ ID NO: 4012 - DNA, 785 bp, Homo sapiens
  misc_feature (1)...(785): n = A,T,C or G
tganccntttgaanccnttttgaatntcnttacanttgctacttgttctttttgcaggatcccatcgattcgaattcggcacgagattcaaagtacatttgacaacccactgcaagttgtggcatacatgggtgccatgaaccatgacaccaactacagctttcaggttcaatgtggcttaattgtgggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccactatgctacctcttatttacctgaaaggaggacacgcaggatgggcagtcatgctggtgactcttgtactcccttgagggacattggtggggggggggcgtggtcccangcaggatgcccantctttgactganattggaangcantgangnttgagggtgccaaaaattncccanggttcacccaganggggangggctacatgccccanctgtgtgcangggaggacacn

SEQ ID NO: 4013 - DNA, 782 bp, Homo sapiens
  misc_feature (1)...(782): n = A,T,C or G
acctttaaacancttntgaantncttgcacgatcccatcgattctanttcnntncgcaggcagccnccancncganttnggcacnagctcnanagctgctgcttttcccntgccnganaacnttnantttagtcctggattctgtcacanaacatntnanctgccnttntccctnnggagaattganntggnaacctacttnagnggcatgaaaaaacctagacntctcngaannganaaccaatnngcccttattgagantactgatngatngtannaccanagggacacccgngnatcaatacatacnggctgntcttgcctntttcaagggtggtccaaacgnccatnctanggntcggatcantatgggtntgcccaagcgatcagaacncgagccatttgcttagctgcgggaatgaacanggntcttgganacnggcatctatatacaccccctttcnttttnccccttgatnggaagcttctctganatgacactctcaaagatgngttctgnagtgacttattgccaaagcaccacttnncctngttgagtttaagangancacatttgggctaaggggcctntgnttngatgtaaagtgatctcctngnggtctacatttttcntaaataatnccttatgatccaccatgagtntgaatactttgcttgggacatangctgccnatcattgcctggaagctgccacaagtacngnagtccctggggcaaatagcttcaaattttttgnactctcaagcccatgtcacatantt

SEQ ID NO: 4014 - DNA, 794 bp, Homo sapiens
  misc_feature (1)...(794): n = A,T,C or G
gnaacctagaaacaagctatttgacttcntgancnttcnaacaagctacttgttctttttgcaggatcccatcgattcgaattcggcacgagcagagatctgcaaattacagcccacatgccagctgcttgtttttgtaaataatgttttaccggaatccaccactcccacttgtttacatatcatccctggctgcttttatgctacantgaagtgggaggggttgagtagttgaaacaaagaccttattgcttgcaaagtctgaaataaacacactcacacacactgatttatgtatagaatatgtatacaaatatatcttttatttatctatttttttgagattgagtctcgcttgttgctctgncgcccaagttggagtgcggaggcaagatcttggctcactgcaacctctgcctcccaggttcaagtgattctcttgtctcaacctcccaagtagctgggattacaggcacatgccgccatgcccagctaatntttgnatttttagtagagatgaggttttgccatgttggccaggctggtctcaaactcctgacttttagtgatccgcctgcctctgcattccaaagtgatgggattatangcgtgagccactgtgcccggcctacaaatatatnttttacagcacatntcaattnctattaactgcattttcaaatgttcagnaggcacccactgggctttgtatcgggntgtactgggcccacacaaatctaaaatngctgnatccttggnacctcctacctcctggtaccttatnagaataagcn

SEQ ID NO: 4015 - DNA, 786 bp, Homo sapiens
  misc_feature (1)...(786): n = A,T,C or G
tttgaaanctttatacagctacttgctttttgaagaccttncanacaagctacttgttctttttgcaggatcccatcgattcgaattcggcacgagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacntattatgcagtatttatatcttttgtatgtaaaactttaactgatttctgtcattcatcaatgagtagaagtaaatacattatagntgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaacccattctccaatctcagtagttttttcgaaaggctgtgatcatttattgatccgtgatatgacttggtactagggtactgaaaaaaatgtctaagcctttcagaaacatttttagtaatgaggatgagaactttttc

SEQ ID NO: 4016 - DNA, 783 bp, Homo sapiens
  misc_feature (1)...(783): n = A,T,C or G
ttttgaaccnttanacancctcttgnnttgaaaacctaganacaagctacttgttctttttgcagggatcccatcgattcgaattcggcacgagaggacctccagttaaatttgaatttcagatgcctatgaatagttttcagtataagtatgtcccatgcaatacttgggatacgattgtgctgaagtggttttcattgtttgtctgaacttcaaatttaactggacatcctgtatttttatttgctgtcttgcaacttggttctgagagagagacccgagttcttcccattcacactgtgtgttgggcagggcatttgggccacttgatgttggctaggtaggttctcatcttgagaaaccaaatttctgattcccagctctgtgccggtactgtgcctttttccactcaagatcttaaaactttgcctaggaagagaagggtcgggaaatggtgggatggggacttgagtgttaatttctgagtcttcttcctggggtggattgcttctgtgccatggtctttgtttcccgttgtaggtgctgaccccatatgctgtctcgactgcaatgacaaagtatctaaatacaaatgtgataaccaagactgctgatgagtttgcaaaaagtcattgaattatgtcacaattggaggtgaaacctgtggctgccttgcccatgaaatcttggcgggctttctgancctgatcccngcctgggccttctacagcggtgcctttcaaaagctgntcctgaccactatgtggcatacctgaactcant

SEQ ID NO: 4017 - DNA, 786 bp, Homo sapiens
  misc_feature (1)...(786): n = A,T,C or G
ttgaaccntnnnnncttttgaatttgaaaccttnaaacagctacttgttctttttgcaggatcccatcgattcgaattcggcacgagggtaacttctctganagngttccttgtaaggctcttatgaacagtcgccatatatatatagttgatgggcngggaagatctgggangtnagcannaagagcctttagttccgccncatagaacaaantagaggtcacaggttcnatgccctgagatatggaattgaaatnttagacttcagggtcatagactcttggaaggaanactagagtacattcntgaccctcncccttaattncttnacaggngngaaaaccangagctncngaaaatnngttattcctcanctccagggctacctncgatctgtgtttgctctgacgaatggaatttatcctcacanattggtgttctnnntgtcttaccacctaattanntnnctgctaccaaaaaaaaaaaaaaaaaactcgagcctttanaactatagngagtcggattacnncnatccngncatgatangatncattgntgagnttggacaaaccnnanctagaatgcancgaaaaaaatgctntatttgcgaaatntgggatgctnttgctttatttgtaaccattataagctgcaataaanaagttanacaacaacaattgcnttcattttatgtttcaagttcagggggaggngngggaggttttttaatttngcggncgnggcgccnaatgcattgggncccggacccancttttgtttncttta

SEQ ID NO: 4018 - DNA, 759 bp, Homo sapiens
  misc_feature (1)...(759): n = A,T,C or G
nnttactatanaatacaagctacttgttctttttgcaggatcccatcgattcgaattcggcacgaggcgagctgaagtacacaaagtttcaaggccngaaaatgagcactcanaaatgataacaagagacaagtagctccaggtgctccttcagctccaaggagagggcgtgggggtcatcggggtggcaggggaagatttggtattcggcgagatgggccaatgaaatttgataaagactttgactttgaaagtgcaaatgcacaattcaacaaggaaganattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagangcagaggangtcttggtttccntggtggcanaaggccttggtggtggcaaangtggtccttccttgccctcgangatttccncgntggattcaaaagaagtcgtgggggcccggagtttgcggattttgaatntaggaaagacaacanaagttgtgcntagtctacaaacaag

SEQ ID NO: 4019 - DNA, 757 bp, Homo sapiens
  misc_feature (1)...(757): n = A,T,C or G
gaatccnntacnatananacaagctacttgttctttttgcaggatcccatcgattcgctcggacataaattatttcattcacaccatcttnccttcccacacacacaccctggagcaaacactggcaccgcntctaacaactcaaggctgtgtcccgaggatgactgctccagctntcttacgttctgcctganagcctgccaagagaatcaactgtttgatagggcccatctacangctttgtganagagtnggggcctaattttgttaanctccannttgtaaagccananagcctaatcgcgtngacanccnccttcctgcttttcaaanattatctgcttncctgaatactgcctatgcctccctnctcctcccttattctccctactgcagnagtgantatggatgaaattatgtncttcctgtattaactcaggtcancttggnttgnntttggcaccgggnacaagtgctgttgggtctgcttgnaccactattccccaantgccactggtagcacanatcaacaaatcctttnctctnagctcatntgttgagaaattatcaggagccatgggaagaaattactattttnatcatgntagaaatatatttcanngtgtnttgaagagtgtnaananttgaaantgggaaaaggatttnangctgcacttgggangcaanatgatgaaccttactatggcactnnggactnaaagtangatgagccccantactgacccccaggccngnt

SEQ ID NO: 4020 - DNA, 765 bp, Homo sapiens
  misc_feature (1)...(765): n = A,T,C or G
gaattccttacnatananacaagctacttgttctttttgcaggatcccatcgattcgaatcggcacgagactggcattctgctgttctcaggagctccgctttgatggatggctgggcagcctgtgctgcatggaccaccagtggttgttgaggtggtgaantgtgtccccgctaactccactctgggcagtnaactgaanagggagcaaagcccatgaaatgggcctttgtggcagtggtggaggtagagtgacccacaacaaacctccccacttgtncctnnccattcagnngntccagaggcagtgagcttggaatcttaacangagagatcttggggtggggtgtggactttccacaaaggcattacctacatgcacgttcccttacacatgtagccttccaatctcatacntaanancacttatttaagtnaaatatgcctatttcaacagcaagaactntggnntggggagtaaagatnttnttanttnactatttagtattaactgagtaaacatttaaaaaggactggatgggggtgggcacatggggctggggtgcatttgctntngctctacatttatgaaagaccncaaatncattatgtgacattttntgnaaacaagggtatatatactacancagatacacaggngctagaanaaaagtncatcataaaacttcacactnggggttgtattacaaaaccacatagcttcatnngganttatgatgtcnggaaaaattattanancttgtnt

SEQ ID NO: 4021 - DNA, 790 bp, Homo sapiens
  misc_feature (1)...(790): n = A,T,C or G
ttnannccttttnaannccnttttnanttccttactatanaatacaagctacttgttctttttgcaggatcccatcgattcgaattttgccatcttttatcaggctttctgtgtcgaggacgctacccacatagagtagaagctaaagggaagggatgtgaagtgacctcaccctcagcttctanctcatggtgtcaaggcttgtgtgatcttagacacntctgcctcttctgagcctgtttcttcatctgtnaaacanggatgggaggttgtggtnaanattccacagcaacactgcacacgcatnaantacctnggccagggatgactcggcngacctcattttccctctgcctcctgcctanagctgttagcaagcatccatcatgcggntcacacaagagctcccccnggaggttacagaaatgaaggcngcagccccagtncttgggtagcctgtttccccttgaaggaaacagactcaatatcagcaacacagagtgaatgacgccagggtggcnaacnggcctttcctgnagcaaatgcgggaggcttcatggagatgacgtgttatgaacancactcatcttacgctgggagcagcacatgcccccggcanggagccagtccctgtcttcaaatacagtcacactgngggttnaacaatgtgtaaatttgggggcgatacaaacattcagtccataacacccctatacccnaacccttaggcaancactaatntacatnttatctttacagatgacctattctggacatgtcatatnaatgg

SEQ ID NO: 4022 - DNA, 781 bp, Homo sapiens
  misc_feature (1)...(781): n = A,T,C or G
gagnnnnttgnancccttntgaaatcttttaacacaagctacttgttctttttgcaggatcccatcgattcgaattcggcacgagggtgtgcggctgtaatttgagctattcgggaggctgaggcaggagaatcacttgaacccaggagacgaaggttgcagtgacccgagatcgtaccactgcactccatcctgagtgacagagcgaaactccatcttgggggaggaaaaaaaagaaagtaatagggaggcaaatcagaatttgtgtgggagtaccccctagttctggctcttgttagtatactcaacctgtcaggctattctgagagcgaaagctcctgctttgggctagtttccattcagaatggtttttgataggtatgaactagtctaagcacaagtatacttctgtgtaagtagcatagctcctctacttggcttcatagcattggacattaatagagaaaatgaaaaaggagggtatggtacctgccttgaatagcatttgatttttaatcctacatttatcagagccccagtttttaaaatgtttaatagccagatgtgctgtttgccaggcttanaagttggtacttctgtgaatgaaaangtgtgactgagtcacataaactggtattcagctagcccagtcatcagtttattccatattcaagggaaaaccaaggctgnttttcctctttatactttgaagatgatggcatttaaaatcaagtaattggggctgggtgtggtggnccacatgtgaaatcctaatgctttg

SEQ ID NO: 4023 - DNA, 779 bp, Homo sapiens
  misc_feature (1)...(779): n = A,T,C or G
gnttatanatacagctacttgttctttttgcaggatcccatcgattcgcccctttgccttccaccatgattataagtttcctgaggcctcctgggacatgcggaattgtgactcaattaaacctgttttctttataaattacccagtccccagcagttctttatagaagtgtgaaaacagactaatacaatcctgaagcatttcatcaaagaattgtaacaggagatgaaacatggcttcaccagtatgatcctgaagaaaaagcacaatcaaagcagtggctatcaagaggaggaagtcaaagcaaagcagaccagtcaagagcaaaggtaatggcaacagtttttttaggatactcaaggtattttccttgttgactttgtggaggaccaaagaatgataacattaatttgcctattgagagtgttttgggaaagttagccaaagctttagcagaaaaacacctgagaaagcttcaccagacagttcttctccaccgtgacaatgcttttgctcatgtctctcatcatcaagaacaattttgttagagtttcaatgggaaatctttaggcatccacctgatctggctccttctgacttctttttggttcttaatcttaagaaatctgtcaangggcccccagttttctttaagttaataatgtaaaaanggctgnattggatgtgggntaaagtcttccangaaccttaagttcttttanggnggtcctnaaanggctggggggcatttttttaccnaaaggggncnttggaaattg

SEQ ID NO: 4024 - DNA, 774 bp, Homo sapiens
  misc_feature (1)...(774): n = A,T,C or G
taatcncttggtttctaatncntgggnctcgnactttctncannanccnntgcgntgcgaattcggcacgagcccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactganaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagacccatcaaatgggtcttactgagaaagcttttgtctgccaatgttgtgtttcctgcttcatcgatattgcacagtacttgtcaantttcaaggaatgcccttcanttagcagaatatnggnattcctttgagcgcccacaaacttg

SEQ ID NO: 4025 - DNA, 734 bp, Homo sapiens
  misc_feature (1)...(734): n = A,T,C or G
gnttatatatcagctcttgttctttttgcaggatccctcgattcgaattcggcacgagctcatcacactgttgtatacttcgtagctattacttctttaatccccaaggacttgtttaacaaagtgttcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggtttgttacatggctagattatgtaatgccgaggtttggcctgctagcgcagccatcatccaaagtgaccctagtacccaataggtagttttcaacctgtgtgcctcctcttctaccttctcttttggaatctctagtctattacttccatctttatgttcacatgtactcattggttagctnccacttacaaatgagaccatgtggtatttgatttctggttctgagttacttcttttaggatagaggatgaaaaagagtgtacctccacttcatccatgtgctgcnaagacatgattcattcttttatggtggatattttacctttttgcnagggganagattaaattggccanntatgaaaaatgctgnatccctat

SEQ ID NO: 4026 - DNA, 837 bp, Homo sapiens
  misc_feature (1)...(837): n = A,T,C or G
aagtttaaacctgctctngtctttgcggatccctcgattcgaattcggcacgagggggttgggggtgggaccctgggatggggggagaagcagctgtttctggagagagaaggggtcatggtggccccagactgtagagatttttatgtgtttggatacatctgctgtgtggaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgaaaaaaaaaaaacaaaaannnanaanncntaaaanancccaaaaanaantaaaaaaaaaanccnnggccctttaaanntttngggngccgtttancttaancccnnnnttnntannaccttnnttnatttgggnnaacccncantttaattnccggnaaaaaatgnnttnnttggnnaanttgggaancctttngctttnttngaaccntttttaagntgcnataananagttaccnncnannttgncttnnnttttaaggtttcaagggtncaagggggaaaggttttggnaagggtttttttaaattnncnggggcccccnngggnnccccaattnncnttttgggcccccgggnncccccaagntttttnnnntcccccttttnangnnaaagggggtttnaatttgnnccccccntttgggcnnnnaaaannnngnggggnnnnntnaanccntnntnnncccctngnnnnnnaaaaaaattnc

SEQ ID NO: 4027 - DNA, 787 bp, Homo sapiens
  misc_feature (1)...(787): n = A,T,C or G
ggnnnnnnnngnntntaatanncagctactngttctttttgcaggatccctcgattcgctgccatgtctagtgggctcttctgggctccgtcctgagtttgtcacacctcctagggcccagaggagatgatgtggtatttctatcactaaaaggagttcaagaccagcttgagtaacatggtgaaaccctgtctccactaaaaatacaaaatttagccaggcatgatggcgcatgcctgtaatcccagctactcgggaggccgaggcaggagaatcatttcaacccaggaggtggaggttgcagtgacccgagatcgcgctactgcactccggcctgcgtgacagagcaagactccgtctcaaaaaaaaaaaaacaaaacaggaaaagtcttagagaaaccttgtgtttattcagaataaaatgaaatagttaaaatgttttagtgccttttattttcaaattacatagtcagtatcttctctcatactgattcttgtttgtatctttacccaaaataggagtacacctttgtcatttaattaattgtttgatataatcttncaaaatatggtatctggcanaggggggtgngagagaggaagaatagcacaaggcttttgtttgggtgcctgcttgctggttggattttgagatccaaatcaactatttttggatgaaatcgtagctaatttttcctgnaacctnttttttttttnggtctctgngcccattggntgcttgggatcaggaaaatgccctatanttttnggctattttggcatttaa

SEQ ID NO: 4028 - DNA, 733 bp, Homo sapiens
  misc_feature (1)...(733): n = A,T,C or G
agnntttatnatcagctcttgttctttttgcaggatcccatcgattcgaattcggcacgaggttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcangtgttaccgctattgctgtgccttgtgttangacattgtgtgtgtgcatggactgngcctccaaactcagtagttcctatctaaatatnaagtatattacaaacctggaagtacagaatctcaaccttacagtctttcccttantcctgtggccttctaaccanctgntaacgtgttgattccttncacttccccaagtaggcangcacanattgtgangcttaaaaagtaatctggttcctntgactcattgaattcantttgcgcntctggctggaacanntgttgttacagnttttaagaaaattgctggntgcccnataagggtggcctggtgctcngggcctgnggctn

SEQ ID NO: 4029 - DNA, 760 bp, Homo sapiens
  misc_feature (1)...(760): n = A,T,C or G
gnntttagatcagctcttgttcttttgcaggatccctcgattcgaattcggcacgagaggagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagantggttcgaaggcaagaatgcagacccaatcctcatctncttgaacacgggtacattccangcaaaaacagggatctcaangtggtcaagaagaacattcttggatagcaagcccactgcaaccaagaagtgcganctgatcagcatncccaagaaaaccacagacacgggctgtgancaaaaatgaacttgtaccgaccatgn

SEQ ID NO: 4030 - DNA, 757 bp, Homo sapiens
  misc_feature (1)...(757): n = A,T,C or G
gnnttttanatcaagctacttgttctttttgcaggatcccatcgattcgaatttcggcacgaggctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgantggcgactgccttcacctcattcccgtgactcgtggcatgcncangtgctggancttggcagccgcncangaacatgtaggcaggctcttaaatgtaggtggcaagtggcacaacttccatgtccgaggcccacaattcggctgatggaagagtctngggaacccaanttcagccctggtaccccttttcatgcntgattngggaacatgactccttttactncccn

SEQ ID NO: 4031 - DNA, 776 bp, Homo sapiens
  misc_feature (1)...(776): n = A,T,C or G
ttttgttccattcagctctcgttctttttgcaggatcccatcgattcggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaancnnnnntnnnnnnnnnnnanntnnnnnnnnnnnnnnnnnnntnnnnnnnnnnnnnnannnnnnnnnnnnnnnnnntnnnnnnnnnnnnnncnnnnnnnnnnnnnnnnnnnnnnnnnnnntnnnnnnnnnnnnnnnnnnnntnnnnanntnnnnnnnnnnnnnnnnnnnnnnntnnnnnnnnnnnnnnnnnnntnnnannnnnnnnnnnnnnnnnnnnnnnnnnnnnnnnnnnnnnnnannnnnnnnntnnnnnnnnnnntnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnncnnnnnnnnnnnnnnntnnnnnnnnnc

SEQ ID NO: 4032 - DNA, 774 bp, Homo sapiens
  misc_feature (1)...(774): n = A,T,C or G
ngtctaatnctggctctcgttctttntgcaggatcccatcgattcgaattcggcacgagaggggccttacattactttcttgcagcactgatggcttntgnttgaggctgcacaaattcctgcatttcccttgggttgaatggnagggatgcgggcagttggtgactgggtgaaccacctgacttgagcagggctacgactctctctgcaaacnaaacccagagacatgaacagtgctganatttctcagtggtttcccatgtaggctgctttccaagggcancaagcatggcttnatcactcacccagtgcttctgattcagcactgtgatgctcggttaanttttaatgaggttntaaatnttttcgtatgtacgagtgtttatgccaacaaagatgctgaattgtaaacaccancaatctgagtaccttcttttgattncnntctncatattgaataatccctntatntttgtgcgtannatgaaattgcatnngatgtatnggttganagtagattggtnatactttncaaggacaggcaacaatttcacgatnnaacttcttaaaaattnttntnaacaaatgtnaaaatggattnttcttccaaaaaaccntttttccntttggcacatacccaancaantgacccngaaatttaaaagtaatttaggngacnngantttagatgattaagggcnngtttaacntttggacagtttttgcccttttttaaaaggctcggantccnnttntagnnaactcgctccccnc

SEQ ID NO: 4033 - DNA, 769 bp, Homo sapiens
  misc_feature (1)...(769): n = A,T,C or G
gnnnnnnntttnaaancnttgctacttgcncttgcantttcccatcgattcgaattcggcacgaggtaaacatacaataaagctgaaaattttagtgactacttatatgctcatcatctagattctatccttgagtaatctatttttataaaggtattgatgtaactattttataaatgaaaaactacacactaaaaaccaaatatgtgatctccagcatcacagaaatgaaataaggatttttttttaacttaggtaatattgcttgaactgtagtaattcaaatgtagcaatttcaaaggtagaatttcccatgtattactatactgcttcacatcagctctattaataaaagtagaacagttgcaaaggaacttttatgatctgttttgacaggacagacaatttaaaaagttgttaataaaggtttttagaattcactataagcctttcatgtggctttagttagccacatggagatccgttctgggacgaaagttggaagtattctcaagaagtaaaaaatnccaaataatttataggggcacnagtggtttgaagtactggttaggattanaagngggtcttggcattgnccanaaaccanactactttgcacaattatncttgaattcctaatcatatccactagcctactctcttaaatgaccccagaaaccttgctcttaacatttaagacaatgggaaggtcttgctttctaaaaatgcctttattttaataccccttgccaataaatggaatttnacn

SEQ ID NO: 4034 - DNA, 741 bp, Homo sapiens
  misc_feature (1)...(741): n = A,T,C or G
cgcaattttnannatnctcttgttctttttgcaggatcccatcgattcgaattcggcacgagctcaccaattagcactgccaccgcaggtctgtgaattgcatgtgaaaatagaatttgtccagaagtgctcatgcaaattgtgcaacacaaatgtggcctccatgtcaagtcctttcacgtgttctgacagactcatgtctttccagatttctctgatcggcgccccccacccccttgacagttaccagagctcataagccaaaggaaatagttcctgttgccatgagtactgtgtctgtggtgaggtttatgagctgctcttagggctgggtttttgcctgagaaaacaatcagatttcgcttagatctgcaaganagcagattaggaagggaatatatgcaaatatctatgttaatgccccaaacctataacttggcctcatggtgcttgtgtagcanttctcttagagaaaactttttttgcatttaatatatatttcatgnttttgaaaatctgtgttcatgcaaagaaacctggaaagcaaaagcatnaggtcaaatatgaacttggctntnattcatataattggggtatatcatatcttttgtgacatanaacngtnctttnataaccatctttgcttttncattggaaaaaatncagctttcctgangaggaatatnttttcantgncnctnttaaacctttnganngnngtngnngcggnnanggggcccn

SEQ ID NO: 4035 - DNA, 775 bp, Homo sapiens
  misc_feature (1)...(775): n = A,T,C or G
gnnttnanatacagctcttgttctttttgcaggatcccatcgattcgcaggactcaagatgactttctaaggtgatttggggatgcagtgtatgcatttttttactctttttgaaaaaaatcttttcttcgcctttggagtgtaacatttggatagttttattcagcccataataggaccaaagggaaggggataaaaaaaaattctttaaagtacctcagataaaaaggttttgtgaagaaaaggactcaaaatcctaggttataccaagactttatgttcattttgaattttctttattcatttttttcctctctgtgtatagaataatcaggagatattggtgggcagaactgttggttgataacaggaagcagagtatctgagaaaggccctcatcctgtttccttttggagctactgaggcctcacatgccagccattttaggatttgatgaaggctagagaagagttaaactgagccttcacttactcagcatcagtaggaagtagtgttggctacactaaaaacaccgttgtgccagtgaggatttggggggaaaatgacaagctgcctgtgataaacaagcaaactgtgacaaactttttgatgtgtaggttctgaagcttttcaagtttaccgtcctcaaaagaatatttatatatatatatatgccccacatgcccaatntngcattatatacctttngatntacctggaaaganaaaangatgaaatggccngtaaaaattgganatttccagggaacccgatc

SEQ ID NO: 4036 - DNA, 782 bp, Homo sapiens
  misc_feature (1)...(782): n = A,T,C or G
ngnntttnaatatacaggctcttgttctttttgcaggatcccatcgattcgaattcggcacgagctttaggttcttgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgnagctcctccaaatatgccccgtcttactaccatgtgatgccaaancaaaattccactcttgttggtgataaaagatcagacccagagcagaatgaaaagctnaagacaccgagtactcctgtggcttgcagcactcctgctnagttgaagaggaaaattcgcaaaaagtcaaactggtcttaggcaccataaaaaagcgaaggaagatttccangcaaaggatgatagccagaatgccatagatcacaanaattgaaaagtgatccagaggaaactnaaggacncaagtgtngatcataatgaggacccggaaacnccaggaaagtcttcnggngggaagaaaattgaaaaaccngccaaatgccttttgaaagccaaactgggaattgagaaataattcaaatncttggaaatttaggagnaa

SEQ ID NO: 4037 - DNA, 775 bp, Homo sapiens
  misc_feature (1)...(775): n = A,T,C or G
aanngtttgaanacccngctacttgttctttttgcaggatcccatcgattcgaattcggcacgagggttcataaacacatggctaacaaagtaaagccttcaagtctggcacagactcttgactacacgatgggaaaagggattccaattacgatttaacttgtattttaaagatgagaaaagaaatgaataagaaaatttgttgctatttttcttcttccaaattagaatctatatctctaaaaatactttgcatgtttagtaaacatccatcttgaacagaagataccttgacatcagttctatttaatacttatggcaattaagagatttagaaagcagaggaaaagaccaaaaaaaagtatgtgttacaaagtgtcatcatgcttgtaggaccccagcattcttgaaactaacgcacctttaaaaagtaatatttacactgctgtaaatatttgcaaagtatcaatgtttaattcacttagaattttaaggattatggatttactagcgaaaattcccctaaagcaactttcccatatcagtaacttttatttagggaaacaagtttaatgtcataatacatgtgaccttggaattcaatagaattttcgaaactagaagtaactcagaaccgttcactagatgtgttttaaagggctnttttgatactggccttaacatttgcttatttgcaaattaatatgtaaagaatgggttctaaaagtaagttttaaggaatgggtatttcnncaaaaatgttatttcctattnc

SEQ ID NO: 4038 - DNA, 825 bp, Homo sapiens
  misc_feature (1)...(825): n = A,T,C or G
ngnnntttnagatacagctcttgttctttntgcaggatcccatcgattcgaattcggcacgagcccaaacctaatttaggagtaaattttttgtagcagatagccagatttcagccaatcacaggcttccagctaacaagactatgcccaaataaggcaaatgcctcatcacatgatgctcaaatnaggcagccacctaggcnaggccaatcaggtaacttttctactttgcttaattgttcagcctgtacaaatttgctgcttatgactgctgagcagagctgtctnaacctcttctggtttggagtgctgccttatatatgaattggtctttggtcacataaaattggttaaatttaacttctctaaagttttgtattaaattgtatgtaaaacattggtagcacaatttggattcagatacccaaatattgactatgataatgtaaataatccttaagcagactgatttacaaaggcctgaacaagtttgatattctgaatattcacttcttctgatgaaaaaattgccaagaccttncaattggcagggaaaaaaaatgtgtgttggttaaataagttatgtttaacaaccaagaacatttaccacaanttaggaaaactctttacctatggcccanggcacctatttttaaaccacacccttttggtacccttttttttaaattcctngaaaaaaattttnttaaattaaaatatggcctttttaaatatttaatttggnanttttaatantttaangtggnanttttaaatatttggccccctggttttttgggggaaattaattgccngcaatttaan

SEQ ID NO: 4039 - DNA, 789 bp, Homo sapiens
  misc_feature (1)...(789): n = A,T,C or G
gnnnnnnnnnngnnnttttnaatatacaggctacttgttctttctgcaggatcccatcgattcgaggatatgttgcactagtngttccttgtgactggaatattctctgcccaaactttgaaaggctagttagttacttctcatcattcgggcttaggttaagtgtttcctccttagagttcttccttgatttatcttccccccagtctaaagtgccagtcacattaatctgacatatttctccatacagcactcatcactgattgatnaaaaatctattttgccatntttctctctcactggaatattatgtgctcatnaagaagctactcgtgtatantgntcctgatcgtctgngctgcataacagattacctgtgtcatataaggtgcacaataactatatgcgntgcgtgaatgancaaacgttctctccagtctnttttcaaatcttctattccatcacgactgaaccaaaaggaaatgtactagacgttctgtctggcagccttgttccatgcttagcctttcantgattgccantatctttnatgatgctgggccttngccttnaccatggctagaatgttagantnatgaacnaananatgccattttgatccctgctgcgttcacctnantatggngcctggcaagcctttaanaacntnatnactcagtgnaccaaatgaatgagtaaacgaccttttnnatcctttnaaggaantnaattngcctgnttataggnaatngttgganccnaattccaacttnggccaattggaaaccc

SEQ ID NO: 4040 - DNA, 752 bp, Homo sapiens
  misc_feature (1)...(752): n = A,T,C or G
gnnntttttngatacagctcttgttctttttgcaggatccctcgattcgaattcggcacgaggcagtctcctgagccagagtgtgctcagacagagtccagctggtggaaagggacttatggagagaaaaagaaaagcgatgtagaaaaattgaaaagaggtacagaaacagctggattggttacagctcggtgtttgccttattttgaacagggtttgaacagttggccacctttggttgctcaaaacttggtgattggcacaagagtaggttacagtctgtttgcacatccatttaggttgcagttcactgtgtacagagaaacctttaggctgaacttaaaacgtgtaaggagacagctttctgcttgatttaacagtaacacgggtgtgtgttgggaggtagggaggtgggggctctttcttntntnannntgnctttttncacaacanttntgangantnagcttgtnatgnatttgngcaactgnttntttntgtnattntaancnngancnnncnnnnnactnattttnanatttnanaaaantncatnnnncnngcnnanccttnctttnnntnctgncnaatnnnnngnngnnctnnnnacnnannatnngnntnntgnnctgnntnngntttnttttnnnaananntnntntnnggnnnnnnnnnnnnntnctntttnnaanncnnnnnnnngnnttnncnnggnnnnnaannnnnnnnnnnntnnncnnnnnnnnnnnnnt

SEQ ID NO: 4041 - DNA, 764 bp, Homo sapiens
  misc_feature (1)...(764): n = A,T,C or G
gnntttnnaatcagctcttgttctttttgcaggatccctcgattcgaattcggcacgaggtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtntntngaaccagttacttctaataatcagaaaggagatgttttatnggacatttctttaatataaagttagagatgtcttcttagcagtatggctatcttttgccacagaacata

SEQ ID NO: 4042 - DNA, 757 bp, Homo sapiens
  misc_feature (1)...(757): n = A,T,C or G
gnnnttttatagatacagctcttgttctttttgcaggatcccatcgattcgaattcggcacgaggttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaaagaaaataagtaaaccttattcattctctgaagtactttccaccactactacaactgatccaagaaaacaatttcccattggatggtattattcagagtgttattaacaatcagtcctgaatttttcagaatagtactaaagttgtctttttttttaatgggttccttncttcaaggttatagtaaagcttttttataaccttcaaagaatacaaagtggaatttgtaatttatnggatatacattcctagtttacaggtactatttaaagctggcaaatttanatnaagatgccttccctttaaattgcccctttaaatctatggcatgtctcacttaagagttccaatttcagaatttcatggcaacttgggaaacggcntganggaattt

SEQ ID NO: 4043 - DNA, 787 bp, Homo sapiens
  misc_feature (1)...(787): n = A,T,C or G
nggtntttnaaaancngcccgttctttgcggaccctcgattcgaattcggcacgagcttgaagtagaattttttttcattccttacacttctcagtgagtggtaactgtagttnttgctatcatttttcattttcgtttttgcagttgaacatacttttttcactcagagagttggagggacttgcccaanactgcccaatggcaatgagatttcaacctcaaatcaatgttctttttaatgcaagatgataaagagtnggattcancctaatttaggatagaataaagccaaatantttaggataggttctttggtgttcatgggtgtaatctaatgcccatgatgcaagtggcagagtanagaattagtgcacagcaataattaaagtgacatattgccaaaggaagcggttntagcccattatataataccttttaaaggacagacgcatactcaggtttattttacctgctgagcttctgccttagaagttttcagaattgtgattacattgaataggaaaaaagtctgaactatcagaaaccagtgccgcaactttgacaaacaactgattattataataatctgcctctagcatgagactatnttaattattatttaagctctggnggacttcattaagcagcccagtnaccaccngaaaggttaaagattattaaaatggaaaggaatggttaccaattnggttattaattccgggaacccttaaggcanggaaaaatgggctttgaaaccccaaaaaggtgggaaggctgcaantgaac

SEQ ID NO: 4044 - DNA, 768 bp, Homo sapiens
  misc_feature (1)...(768): n = A,T,C or G
ngnnntntttnnaaatacacgctcgttctntttgcangatcccatcgattcgaattcggcacgagggggaaagttttcagttgtattatnagntggattctgactatttgccataactgtattctatacacttgctgaaaacattgaattagggaatactgaatcatggctcctaagggaaagacagggttaggttcctggaagcctctggtcacaacattttcaccaactgatcaatagataaccttgttntgtttatgtntgtgtttagagacatttaatatatatngttgacttactaacatcgaactcatggccaatagcactataacttacggctgaacaaagcttatcaagtcttttctctataaggcacatcccaccttcttgcacttaggagcactagacggcatttctcagcactatacaaggggctatttaaaacagaataatcacccacaaaaagcacaacaattcanaaaaannaaaagcnaaagtcttananaacanaacattgcataananttnanaatcagnaaaaanttngccctttaaaccnttaggggncgnttcccanngnccnancntnatangatccattggtaantttgggacaanccncanttgaaggcnntgaaaaaaagctnntttngggaaatttgnnatctntngnttaatttggaaccttttnacncnctttaaccnnttnccacntccnttgnattnattnnntnttnanggttcanggggaaggttttggnaagtntt

SEQ ID NO: 4045 - DNA, 794 bp, Homo sapiens
  misc_feature (1)...(794): n = A,T,C or G
ttgtctttttgcaggatcccatcgattcgaattcggcacgagaacatgagggccctctatgccagaagtgaattcatctcacaaaacatgttgactctagactggtgcctcctccagctactactacccccattagtcacctagtaaaaaatgacgacatttcatcacctgcacatgaaccgctttccccccatttcttaatcatgaattnctgtgtcttaaattattaatggctaagactaggtctggcagtaaattnctntctcctggatttttggcccaactcgagtatttttgaaaaaccgacacagtattttaggggagcccaaaaaccatgatgggaaaaagaatgagctggttgtaaaggaagagggtggcagagcccctctccagcagtgctcacagggacttccccagggcaccaggcaccatctggagacggntttggtcacactgggattgcggggagtcacctagtgggtggaggggccagggatgctgctgaacacccaaagtgcacaggatggctgcagtcgancatgtcaganaaagggtctggccccaaaagccactcgcgccggtggctganacaancttggagcaagggaaccctttggtcaaggnccccangttttttaagctaaaacgtaaancaggaaccattcaagccaagaaggagttcccaggnacgttttttttnttanggaatggaccctttaagaaaaattgaaaancatnnttacccatggggttnaacccccatggaaatttccgggccaaattccaagtncctn

SEQ ID NO: 4046 - DNA, 750 bp, Homo sapiens
  misc_feature (1)...(750): n = A,T,C or G
ntgnnttttaatactngctctcgttctttntgcaggatccctcgattcgaattcggcacgagactgtggagagatctcagtttttctatctgtaattgctcatattttgaatgctaagttttcatcaaccataatttttacgtgctctaatatgtttcttcacagattcatgccatgttcagtttaaaagagtcctgttcttttaatacattatctttgaaatgcctcttactgaggaatgactaaacttcttctgaaatgtgctctctggattgaagtcaagagtacatgttgcaacaaagataatcatgacttttagtattaagagacaattaccagattgagtgctacttanaaaagtttccctccctgtgcagagattactggcttatcaaacaacccgccccatgtgggccatatatnattgagataattantntccaactgatactaaaaggngtaattgggataaattaattttagcaaagagtcctgtntccaaagaaattgggtcatgtatttggcaattaccaaaaagtcagtngtcaaatatgaatgataccgtggtgtgcagtgaacaatcaatttactnaagggaggctggcctttaccttcgctcttngagacanctctagcctggaaatcatgcctgataggatgtcttncttgnganggactgaaaataaagaatacctgaaatctggangattttaagaggtggtgtgaatctgttnaagaaaggtgaggaan

SEQ ID NO: 4047 - DNA, 824 bp, Homo sapiens
  misc_feature (1)...(824): n = A,T,C or G
ccctttnaantcccttgttgtnnannagntnggaaactnaagcttcgtaaaaganaggnttgggaatnnggcncggggaggaagcattcacatatnctagaatantatgacttggctatcaaccccttgccggctgnagctccccatnngctgtagtcctgtatgtgctatacccaacctanagcacggcgccatgcctggctaatttatnctcataactttctacagagatggggtctcactatgttgcccatnctggtcttnaactcctgncttcaagtgatctncngcctgagcctnccaaagtgctgcgattatanacttnaancnatcgacttggctcaaatcttngttntaattggncctttngtcagaaagaatgtgccactctgaantttgttccnnatattgnnntcttnaatcacttnnaacctattntacannnatnttnatttnctcatgaaantgctgggattatnnacatnaccaaatagtgcttggctcaaatattcgnttcaatagnnnctttnatnncanaagactntgccactnttgatttngnntcangngtgttaagcttagtancttgcacttanctggaacctattatncntttnaattttacttnnatnncatcttnctaatcnnaatntcnatctnnaatnnanctttntaatnncatctacnnccngnttttnnaattttnctgatnactggnctanttttanccggnnnttntaaataacgnncnnaccnanatntntangcatnnactcttcccntgtanttttctncnaataaatntnncggnaanatacnnnacc

SEQ ID NO: 4048 - DNA, 779 bp, Homo sapiens
  misc_feature (1)...(779): n = A,T,C or G
ttctaatgcttggttctaatncntgggctctnganctttctgcaggatcccntngatncgtataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattctccgagcttcgcaatgccgctaaggacgacaagaagaagaaggacgctggaaagtcggncaagaaagacaaagacccagtgaacaaatccgggggcaaggccaaaaagaagaagtggtcaaaggcaaagttcgggacaagctcaataactttagtcttgtttgacaaaagctaccctatgataaactcttgtaaggaagtttccaactattaacttataaccccaacttgtggtctcttgaagagactggaagattcgangcttccttggccaagggcagccctttaaggancttccttattaaangann

SEQ ID NO: 4049 - DNA, 805 bp, Homo sapiens
  misc_feature (1)...(805): n = A,T,C or G
ttccaannggctnggttctnatncttggcnannaaaantnggtnggaattcggcacgagctttgcagccttttcctgcccttaaatttgatacctttggtgtaggagctgcataagngacagttgctgnttttacgttnncacgcgtgatcttgaccctgctagcctgaagtgtatggtttctcttagccagttctaatttttgttcaggtggaagatggatgcctgaagtgtagactgctgctagctgaataccatntgggagcataaaggtgacctgaaggtagggngatatgtcttaaagcactttgtaatgggaatttttatcaccttttaaattggggttccttctctagtgagttttaatgtcagtaggtacattcngtantgttgctctgtctgtagctattaaggngagttaataaatgggatagcctccacagcttatttttgggaaggttttgctgatacttcctgagaagcccanggaaataaatacgcatagtctggcattctgcatcttctttaagatttgtttntatgtgtangtaattgagttttttaaaagcttgngaaatcngcangcatattaccaaagttcttgattaaaatggtaatnncaanaaatntttngctgtcnaattgagtacntttaatttcanctcttaatgatggnccntcggtgnanggattttgaaaaattccgaatctttcaccatngaacttaccctaggaattcantttnganaattnnncatggnnaantcttgnnnggantacctgaaccataaatttcccnggtcncg

SEQ ID NO: 4050 - DNA, 789 bp, Homo sapiens
  misc_feature (1)...(789): n = A,T,C or G
tccccttttgaaccttgtccaatnagtctnggttctaatcncttntcnannagnnaggngntgggaattcggcacgagtattagtgataagtatatatggacatcttttggaacaaagataactaacaaaagacaagaattttcaagaaggaaaacaaagaaaaaaaggtaatcagggtatgttacatagnttanctgcttatagttnttctttggttctgctcatggaaacacaatgactatcaatctaagtaagactataatatattagaaggatgggtgatgagaagtgtgaagtgttgcaaaggtaaatccttatcttccgctatgaagtatcaataagcaatgcccaaaaaaatgaactattaagaagtaactgtaaagttatatcatttanagatagagtggagtatagcaaatgaatcagctaaaatatnttnaaaatgggtaccctctggggagtggaagatacatgtatgtattgngggtgggggatgcactgcaatgagatttcttttttttaatccttgtggtactacttagntctctaaactatttgcatctataactttgctaaaaataacntttaaatttncaaattgatcactcttgtnatcagttcaaatngaaacaaggagataacataattgctaagnttatttttggcatattnatcacnttgtatatgtntcantgagaataccatgttacattcctctcaagcangtncttcttaaagtcnaaattgctgnattatttctcaaaaacnattntngnantncactttng

SEQ ID NO: 4051 - DNA, 785 bp, Homo sapiens
  misc_feature (1)...(785): n = A,T,C or G
gcgtcccccttttgaaactcttcaaatcccttggtttnaanccctttncgcaggatcccatcgattcgaattcggcacgagatttgccttaatcttgggttactagtaatgctatctgcgctgtgcgtctaaagcctccagaaagattgctcaggcatggcctaatagcttttatcagttcactcagtggctcttacactttgatacctgaaacctagagttaactgtgtaggaccaagctcttctgaaggagtcaactgctctcctctgtcaataatggctgtttatgccaaaacagccaagagaacctccccacccccttccctctgtcaaagtgaaatggaacctaagaatggaagctagtggctattttgccataccccaaccaacttgctattgcttaattccatctaattatcagctgggcgtcgtggctcatgcctgtaatcccatcactttggtaggccgaggcaggaggatcactagaggtcaggagtttgagaacagcctggccaacatggtgaaaccctgtctctaataaagataaaaaaattagctgggtatagtgatgggtgcctataatcccagctactgggaggctgangcaggagagttgcttgaacttgggaggcagcagttgcagtgagctgagattgtgcccctgcactcaaagtctgggcgacagantgagactctatcttaaaaaaaaaaaaannaaaaaaaactcgacctntagaactatagtggagtcgtattacgtagatccnactgataggatccattgg

SEQ ID NO: 4052 - DNA, 813 bp, Homo sapiens
  misc_feature (1)...(813): n = A,T,C or G
agtctcccttttaancctttcaaatcccttggttcangcctttacgcaggatcccatcgattcgaattcggcacgagcttgagagaatagatctagatgggtggggcacggttctggggaatggaagggccaaagaggaaagtgggcaatggtggggttgagaacgcagcttctggactcagcaggcctgggttcaaactctgttaatcactcctgttaatcccagcgctttgggaagccaaggagggaggatcacttgaggccaggagttcaagaccagcctgggcaacataatgagattccatctctacaaaaaataaaaacaattagccaggtgtggtggtgcacacctgtagttccaggtacttggaaggctgangcaggagaattgcttgagcctgngagtagtgagtcatgagtgcagtggcacgatcatggctcacttgcagccttgacttctnaggcttaggtgaccccccaacctcatcctcccaggtggctgaaactacaggcacatgccaccatgcccaagctgatttttttgtagagacagggcttcaccatgttgccaagctagtctacaaaagcatctganttttggaagtacatggaatttgttgtaacaaaantatnttgaatggaaatggctctcantgtatttntggaattttccattaaataatttggcttttttccttgaaaaaacatannnctnctttntnntntnnatacttnccccttnnttantattatanaatntcnttcnagccctttnncaanttntcntgganttnnttattncattttatccct

SEQ ID NO: 4053 - DNA, 778 bp, Homo sapiens
  misc_feature (1)...(778): n = A,T,C or G
tttgaaatccctggtttcaantccttgcgcaggatccctcgattcgaattcggcacgaggcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctncaaccagagctgacattatccatgcatgtgatattgnagaanatgcagctattgcttatggatntaacaacattcagatgactcttcccgaaaactttcaccattagcttaatcaatttcctcttaataagctcactgaacttnttcgacatgaccatgggcannccgttggcttcacttgaaccactt

SEQ ID NO: 4054 - DNA, 744 bp, Homo sapiens
  misc_feature (1)...(744): n = A,T,C or G
agtctatancagctctgttctttttgcaggatccatcgattcganttgngnacnangttngtgcttnaccactgcttactcanggcccgcnctttgcccgcatttntgcanatcnnacccctancccangagcctctggcagacttaanagcctgctgncctcaccagngnnccnacatngccggnctgagancnagtgnngagtcacagnctcagncanaatgccnaacgcctcnanctgntcctgacngntnccnaggggacaccatatagccttagtcatgnntcatatgcccggangaatcttcccccagangggactatcctagncnacnagatttgtgtcnaaatntctgcttgntgttngaacctncanacnatatggnanngacacactatggaagtctggaattncatgganatttnatgatatgaantaantgtgtangctcctggcatagcaatgntgtnttacttcggagntnaanngannctggacgttgcngacntgntccntaatncaangcaccctnatggangatagcnggacatnctgggcttgnnnatngatcctgntgaagcaannctgcgntgtgattattacccgtnggctggngnccaccagcactggctaatgctntacggctnnagtntctttgtcagnntattnaatggntatgtaaactttnagaattaaantgggnnctnttgngnnngantannttaaccttacntntttcctat

SEQ ID NO: 4055 - DNA, 1017 bp, Homo sapiens
  misc_feature (1)...(1017): n = A,T,C or G
gttncttccatcagctcttgttctttttgcaggatccctcgattcgcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgntnaatatgatatgagggtaagattttnnatanaccnantgtaacnttcttagngcctttagttncaagaggcttgcatacttnntnatnaccantatnacacgcctngnntttntcnnannnnnctnctgcacacacanaccntntnttnctngtatttctgntncgacanncntnnnctntcntcttacccnncctnctnantnnccnttncctcccnnntccnccccccncgacacttactnctnncctncnncctnnccctcnnctnnnnnnncnnnnntntnccncncccnnnnnntcnnnactatctnntcccnnctanngtctnncttncnntcnantntntgcntcnncnnttctnntttnttcnntcatntcncancnncctgnnncctnnnccnnnnnctnncnncntntnttnaccnnngncnctcntctcttnnngnnctntcnnntcntnctcnctcncnnnntnnngctnnnnatnctnntntatntcntcnnnnntnncacnntcncntntcancntctgttcnnnctctcanntcatcnntactncnntntnncctnnnncnnncgcnncnntctctctnnannttccncantnnnntcnnnnanncnncttgatctncatcnnnnttctcntncncatgntnncnntcccnnatttcntatnnngnnngnttacctnctntcnnnatcnntcnnnttacnntcatcncccccctgntntccnntncgnatcntcnannccnntntcncg

SEQ ID NO: 4056 - DNA, 747 bp, Homo sapiens
  misc_feature (1)...(747): n = A,T,C or G
tntttananatacagctcttggttctttttgcaggatcccatcgattcgaattcggcacgagggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacanattccancantaagtagatnaggttgngttttttataaaagataacgaggcattccttccagaaatgtggagcctttgtagatttcagtgcataaaacccaaccatgatttcctgcagtgatcacagagcagagangggagaaagcccttttatcacnaaccancaggaagtctctgtaaaatnggtaaggattctggtttantgtgaagaaccccatttttgngtatgttctgggccctgggaaggacagatcatatttgacntcanaataaatgatcaggccagcatggtggttactctgaatcctaccctttggaagcttaagtggaggattgcttancccanant

SEQ ID NO: 4057 - DNA, 788 bp, Homo sapiens
  misc_feature (1)...(788): n = A,T,C or G
ngtattcacaagcgctngttctttttgcaggatcccatcgattcgtgaaaatacttatctatagaaacagtgttgtaaataagagagtctcagattatcaaatgaaacttatttaaatccatgtaactgaactaataataccagctgcagttttatcctggctgtaaggactaccatgatgggaaaaaataagaggaaaccttaccctcccccacattcccacatgaccagcagcataagggctccaggttaccacagtatccatcatttgtcttatggccacccaagtacacctgtttacatgacttactgggcctgtgtagaaattgcagtttgtgataggatcccagtatagaatcacagaaactgacttttgaagggtaatgtaaaggctatttgtatctaacacttttttaaaaaacagtatgcttttgttttatttattggagtatatttttgaagtccctgtcctctgtcactgctcagagtaattatcatctggtttatattttctagagttttttgtgatnctataaattatgtcttttgttatgtaacacatgtaatttttttacaacaaatgnggntaatgctataccataatctactacaactttgaangggtttcccccgtggttggctactttggatctggccttggtngatattttatatnttatantataggctctcgttngttaaattccatttaaccaacttccntggaaanttcccattctttgaaatggncccattaanttatttaaattantttccctcttgggagg

SEQ ID NO: 4058 - DNA, 761 bp, Homo sapiens
  misc_feature (1)...(761): n = A,T,C or G
gtnagatacagctctgttctttttgcaggatccctcgattcgaattcggcacgagatgaggtgtgangccnttnaatccgaanaagngcncnaagantgagaacgtgattgcntgaaatgttcatccaganatcttggnatataggagaacagggggagactngattgattaggttggnaatatttgtcctatggaccacggtaacggggnttagcnttcatagtatgtaaccaggantggnagnnggagtcatagagtatnggnnctcttnatcccaggagattcccaatggggncagtatctactgnccttnnngagagaccatgctnngctgtctnttttanggnnaatcannaatttagtggtcgcccctncaatcttcattccactcatccntaccctnttggcattcttaatgtnatttgtggccctgtccttatcattttacaagggtaaattntcntccagatatangaacntgtttactaaactttaagcncnttaanttaaacatcnttacctaagaacantcntggtnncaannggaggttnacaaggggctagcgctntaaaaccactctncttntttnccggaagattgccnntctgancttgtaagntnangattcntgtggacangaaganttgtggcatnacngtttnacngntgggttactantgcacntgtcaactngnngngaaatgtcntggatacaangtgtnatggggntgaatttnaacgggacncaanggtggnggc

SEQ ID NO: 4059 - DNA, 804 bp, Homo sapiens
  misc_feature (1)...(804): n = A,T,C or G
ggnnnnnttgtctatagctggctctcgtctttctgcaggatcccatcgattcgaattcggcacgagccatcngtgnctngcnangggcctgccccataggatggcctcagcaaattttcagtgaactcaagttcattganttccaattngtgaaataaactagagggcctctctgaactgccngcctnatgagaangactgtgannagtanccngnccaanacagactgactgtgacaaanctaganancattacaggtttctgagaaagaangaaggttcaagttcacattggtactgtgaccacgncagctcattgccctcctanacngggctctgcaagctttctntttactggaggctgnactactctttnaagctgnaacagtgtgattataancccnnantnggccccctttgacancatctttacaataatgctcttggttcctcaaccngctggtgactctgaaagctgatgnngacgggntgccaaaantcatnatatanncagcctncnaaangcngtgatctctncatganctcatgnanccttaaacncgtgcttgcccnttnttttacaccnttaacaatnttgacatncacctnnatgcctntngcgaantcaaatncccgtangtccaggcttgaaaangaaacacccgttntaggttgggacctttccacaagntcctnatgcnggggnaanaacaatgnnttcattgnnnnganaatncgtcaatcccattggnttttanttngtnccttttcaaacgcgngccttttaaanatngttggnaacccc

SEQ ID NO: 4060 - DNA, 750 bp, Homo sapiens
  misc_feature (1)...(750): n = A,T,C or G
ttnntcagctcttgttctttttgcaggatcccatcgattcgaattcggcacgagcccagccataatggagcctgaaatcaggaattcatgtttcaaggttacatgtacaaatgtatgccctctcagaacaatggccattttgagaaagccagtgagagacagccagaccaggtcctctggcctagcacccaccagtgcctgccagctcagcccaagtctcctcacctaggatagcttgatggaataacaatgtattttaattttctgtagacctaaaactgctcttaaaaagtctattttaaaaatccatcattaaaacacagactttctccataataagaagttggaggggctgggcacggtggctcgcacctgtaatcccagtactttgggaggccgaggcagatggatcacgaggtcaggagctcgagaccatcctggccaacatggtgaaaccccgtctctactaaaaatacaaaaattagctgggtatggtggcgcacgcctatagtcccagctatttgggaggctgaggcaggagaattgcttgagcctggaaggtggaagttgcantgagccgagatcgtgccactgnacttttagcctggcgacaaantgagactccgtctnaaaaaaaaaaaaaaaaactcgnccttttagactatagngagtcgtattcgtagatccagcatgataggatccttgatgaatttggacaaccacacttgatgccgtgaaaaaatgcttntt

SEQ ID NO: 4061 - DNA, 851 bp, Homo sapiens
  misc_feature (1)...(851): n = A,T,C or G
anaannngtcaatgctggctactcgnctntctgcaggatcccatgcgattcgcttgaacctgggaggcanaggttgtggngaantcaagatcangccactgcactccagnctgggtgacnngagcagngactccatctcaagaaanaagtnantaacnaatnnttcgngnatgtgatgactgactntagtcnttatggaaaataacttcnggcagctnagtanctactggtcancaattccgntgtntaagagangtnctacantcnantnctcaatattntcagnctgatttcaatacngacacgcnaccactgaaatgcngaaagatggnaatcanagtgtgatgttnntatnnaantctcgagattcacatgtaatnagaccctttancttnaatgatcacnacatnanaatggngacatgatcttaacttgggaacatatggantntgtatttgnnaattntagnntcacanacntatccctatgantgngacacncatgnctgaaatctaagctttanaatattnnctntgtcagtnaaacagcatgnttncatgcnnactgaanctaanntcccaaatnaantgntcatttttggatngnnngnancacattgtnaaccaattcgttgncaacttntgnntancaaatnnnnnaccatanctcnnntggnaccnatggaagggatnnnatnnnancaanaanccttnggnncccntctangnncctnttngtagangncncaanttcccnctcntgnnccangacatggnncnnggantaccccttcattaattttggctnntatancctcaananttgaaattccnnnnncnanaaattnnnct

SEQ ID NO: 4062 - DNA, 762 bp, Homo sapiens
  misc_feature (1)...(762): n = A,T,C or G
ngnnttnatcagctcttgttcttttgcaggatccctcgattcgaattcggcacgagcttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcagctggagttgctttgcatttcacagtacaaacagcagactatgtaaataattggcagaaaaattctactttgctgtggaattcccaaactaatatggaccagaaactagctaatcaaatcaattatctccaacaaactgtaatgtggctaggagattgagtagttagtctagaatatagaatgcagttacaatgtgattggaatacttctgatttttgcattactcctcatctgtataatgaaagacagcatgagtgggaaagagttaagaaacatttgaaaggtcatactggaaatttactttagatattatgcaactgaaggacaaatatttcaatcttctctggcacatctgacactaatgccaggaactgaantgcttgaaggcgcttcaaatggattagcagctattaacccattaaaatggatcaagacnaaanaaaaaaaaaaaaactcgancctnttaaaactatagngagtcgtattcgtaa

SEQ ID NO: 4063 - DNA, 759 bp, Homo sapiens
  misc_feature (1)...(759): n = A,T,C or G
gtttatncagctctgttcttttgcaggaccctcgattcgaattcggcacgaggtcagaggtcaacaatgagtatgtggcaataacaggattcaaacccagatctgttagcttccaaagtccttggtcttacatgctacccactagttccttggagggggctccggaccatggaggtcacacaccagtgctccgagtgtggtcctcacagcacctgcatcaacatgaggttgggatttgattaaaagtggatttctggggccacccacattctgaatctaaagttctgggtgtggttttaggaacctgtgcttttaacaagtacccttagtgatttatatacttactaaacacttgagaatcactgatctttccagtgtggtgtgacttatagacagtgttggacagaaatgaaacaaaggagaaagatgaagcacagacagaaagagctgggaggatgccctgcatgttcttatatctgtaaatacgcatctcttctcctttgtctcagcccttgctgtttaaatctagacccttacatttttcaactatttggctccagcctncccttgcctgactcctggctttgtatattacctctctttcctgactttcactgccttttacaagtttgcattttctgctcatttttagaagatcctactaagggccaaaggaaaatacactgtacagaaacctaaaattaagccctttagaactatagtgagtccgtattacgtagatccagacatgataggatt

SEQ ID NO: 4064 - DNA, 761 bp, Homo sapiens
  misc_feature (1)...(761): n = A,T,C or G
gntttnnncagctcttgtctttttgcaggatccctcgattcgaattcggcacgagattctcccaaaaaggttcatcccgagaacactgaagaataatttttgggaatgttaatgatgtgccacaaaattagtattttatgatcaaatgaatttgctttataatattttatctaaatattcatgctcctgaagactcacaaaataaaggaaactttatccagctttttccagaatttacttgcacatagactccatttatatagcatgcctattgaactctgtaaatagtgcagttcaggaaagatagcagtgtgggaaatgtcactctaatggtcatatacgtttatcccatgggaggttaaagcatataggtgagaggagagtgatcgccctggggaactgtaatgagaaaggattgatggctgtttcagttgttgttttcctgtccctggctgctggcatgggggcaagggggaggctgaggctcaggtcttagagaacagaacattgcatttcacttcacagtcagcaaagagaaagccaggcaagcacccagaagtcagtgccccagtggagtcacaaaagactattaattcttnccacattgaattgtgacacacaggaagctcattacagactgagtgccctgagtttttatttggggctagtcatgtaggtccctttggctccatgccccccaattccagacttccagaaagaaagccagaattcaaccttaactggcttggttggtcnaacca

SEQ ID NO: 4065 - DNA, 782 bp, Homo sapiens
  misc_feature (1)...(782): n = A,T,C or G
ctcttgttctttttgcaggatcccatcgattcgaattcggcacgagaatacacaatttacatgtcagaggatggtagaggaattgtcacttatgcttcagtctgacttagtgaagcagtggggccgagaaagcaatcatatacgcatttgtctcacatgagcagaggaacagagggatgactttaagttctgtctgttttttgtccacaaggaattttcttgtgggcaaattgtgaggtctttgtagctatcttattttaggaataaaatgggaggcaggtttgcttgatgtagttcccagcttgacctcccttttccttagtgatttttggttcccaagatttattttcttttcacagaataaattgtctttcagacccagagagcatcacagtcacattcagaaaggtgtccaaatgtaaatcacactttcacatagaattacagctatattaacaaattttttcttccattgncttcatttgtaatatataaaaaacttaagcttttaaaaaactaaagttgaattatggncttaaaaatgatggtcaatcttatcttcactggcaggatatagaccatttgnctggataattttaagtaagttgctatacagttttangccttcctagntattatttggtggggtanttctcttactttccctgggnccagttttnaccattgggaaccccccccttaatngnccaccntnttttnccccccccanaaancccanncnntttaaaggggggaaaatggcccctnattaannccnnggg

SEQ ID NO: 4066 - DNA, 576 bp, Homo sapiens
  misc_feature (1)...(576): n = A,T,C or G
gnntnannttcantatanatacaagctacttgttctttttgcaggatcccatcgattcgaattcggcacgaggctggtgttagggttctttgtttttggggtttggcagagatgtgtttaagtgctgtggccagaagcggggggagggggtttggtggaaattttttgttatgatgtctgtgtggaaagcggctgtgcagacnttcaattgttattaaaaaaaaaaaaanaaaaaaaaaaaaaaaaaaaaaaaanaaaaaaaaaaaaaaaaaacntcggcntttaaanntttaggnngtcgtnttacntaantccngacntnatannatccnttgtnaattttggncaanccncacctnaatgcatggaaaaaantgctttatttgnnaaatttgngatnctatnctttattngnancctttntaanctgcaataancaagttancaacancaattgcattcatttnatgttccaggttcaggggnaggtntggnaggttttttaattcgcggccgcggcnccaatgcnttggncccggnncccanttttgttccctttantgagggttaattgcc

SEQ ID NO: 4067 - DNA, 771 bp, Homo sapiens
  misc_feature (1)...(771): n = A,T,C or G
nngnnnnnnttttanancagctctngttctttttgcaggatcccatcgattcgaattcggcacgagactgaatgggctgtatctggggaatcaaggtattagggttgagcaaaagcaagaggaagtagagcatttgatctcttttcctttgattaggttgaggacaataaagtctcattctctcccttnttcccatgggcagccttatatatgattgaagaacattantgcananattcctcatccnnaaataaactctngtacttntatactaattaaagattcatgtnaattactaanttcttggaaaactatggagaactctgtgggggctgtnattcacactttantatgaattggnttaatgacnactgtnatattggctacataaagaaatggacgtttttatttggggttaggggatcacagatgtggactggcttaggtagaatggtccctgagcnaaggagatattgaagnttatgaggatgtgcaagataagcagatttacttttgcattttattttgggctatctcagcttcttttactagaagctcatgcctataatcccagcaccttgngaggccaaggcaggaggattgctttgaagccaggggttcgagatcannctgggcacaaanccagaccctgactntccaaggangattcaaagatttctgatggngaaaacctcggcctntaaactattggggtcgtttacggngatccnganatgataanancattttngagtttggccaaaccccacn

SEQ ID NO: 4068 - DNA, 787 bp, Homo sapiens
  misc_feature (1)...(787): n = A,T,C or G
ggnnnnnngnnnnnnncngnancancactcgnnagnaaagcccttcccancgactcgaattcggcacgagccaccctggtgctcctccctctccctggtaccctgactaccaggaagtnttgtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgactnaaaaattgatttgccatgtaaaatgtatctgcattttttacacaaaacttgntttaaagcataaaaatttaaaactgnnctcttggatgtattatacattttgaaccatatgtattaaaccataaacagtntaatggtggtataataaaacaggcattaatttnttaataaaaaaaaaaaaaaaactcggcctttaaactt

SEQ ID NO: 4069 - DNA, 799 bp, Homo sapiens
  misc_feature (1)...(799): n = A,T,C or G
ngnnnttntatancagctctngttntttatgcaggatcccatcgattcgaattcggcacgaggtccattacaccgccagcagcaatgtcttcctcggccatggcagtgggtcacgggtgcagcagtgcaatgtcttcctcagccacggttgtgggtcatgggtgcagcagtgcaagaccttcctcagccatggcagtgggtcacaggtgtagcagtacaatgccttccttggctatggcggtgggtcacggacgcagctgaatcttgaacacacctgagcctctgcctccacgtgacttggcggtagcaaggaatgaacacagttatctttttaaccaaaattttagatcatgatctcgctgtactcgttgacagtattcaggtacttgttgaagaattaatctctgctcttctctgaagtctgatttaatcaccccactcagctgccagtgaaattgggggtcatccatcgcatctcggatgtggctggctgtggctcttctgaaaagtttctttcttctgccttgtttccatatttagggggaaatcagcaagattctagagtatgtatgtgggctgggtgcaagtggctcatgcctataatnccagcactctgggaggcttaagcgggtggatcacccnangccnggaatttggagaacagtgtggggcaacatantgagaccttgtctnttccaaattaaataanttaattnnncngggaaannnnnnnnngnnnnntnnnnnnnnnnnnnnnnnnntnnnnnnnnnnannnnnnnnnnnnnntnanntanaact

SEQ ID NO: 4070 - DNA, 785 bp, Homo sapiens
  misc_feature (1)...(785): n = A,T,C or G
ggnnntttaatcagctcttgtttttntgcaggatcccatcgattcgaattcggcacgaggatatgctttagaattaaggtgagtggtattatctctagtttgagacaaagagaagcgaagtaacaaaaggccacataagtgataaatagtggacctggagtttaaacctgggatccccacctaaatcagaaatacaaaatcaaccacttttttgatgatccagggtctatgtatatttattacatgtatgtatatatgtatatatatatgcatgtgtatatatgtacatacatacatatagatgtgcttgtactagtgtttttcccaccagatagttagcctttcttctccccttgctcacttttttttttttttttttgagatgaagtctcactcttgtcccccaggctagagtggaatggcacgatctcggctcactgtaacctccgcctcctgggttcaagtgattctcctgcctcagcctcccgagtagctgggattacaggtacctgccaccacgcctggctaatttttgtattttcaatagagacagggtttcaccatgttggccaggatggtcttgaactcctgcctcagggggatccacccgcctcggnctcccaaagtgctgggattacaggcatganccactgnacccacccaaggggnaaaacttttatttagaaaaaacttaactttcactcgttagaaaaacgngttttgaataatctaatttttaaaaatgcattaactatgtcttatnttggctnacacattttaattgn

SEQ ID NO: 4071 - DNA, 792 bp, Homo sapiens
  misc_feature (1)...(792): n = A,T,C or G
ttnaaccagctcttgtctttgcggatccctcgattcgaattcggcacgaggaggaagtgagattgtgcatgacatacttctcctttgtattctctcagtgccttacagcaggttactccattctgctatgacaacttgtttcaaatgttaatttacataggattttttataagccattaaggcatatgtatagtatatcagtaaagatggatggtgcatatataaatagtcttctgtaatagtgattggatttacttctcaattatgagagacaaaaattatcccctcacctgtctctattctttcaacaggttgatcccttttcatgatttttcattaggtggttcaggaagtttccatattacagcgcttcagactgtatatgttagtttaaaaatcacttttctctctctcaacttctttcttttttttttgaagacttaatttaaaaaatttgggttgttagatccgtatcatagatttggcctagcctcttctgttaacctagtccacagatgagcgaatctggttagttgaaggacattgtgatttgactctggtcacgcgaggaagtagaagggcaaagacaggaccggcagtttacatttccagtggttaaacctcacgggactttgggacctgcttggtaactttttgggggtggtctggaggccaatctaacctggaccattttctggncccctcaacaagagagagggaaagcaaccttgggccaatgaggagtaaaaataaccttgggctttcagagatttgaagaatagaagaacttct

SEQ ID NO: 4072 - DNA, 802 bp, Homo sapiens
  misc_feature (1)...(802): n = A,T,C or G
tgnnatctatgctggctctcgttcttttgcaggatccctcgattcgaattcggcacgagcacacttggagctcatacaaactttttcccaggctattgtctgttcttcaagcccattcacctcccctaaaaatcatgtattcttcctcaaaaattgnctattatcttccacttccctttcccccatgaaaagtgttgaggcttattctgagccaatatgagtgaccatggcctgagaacccaatatgagtgaccatggcctgagaaccatctcaagagctccttcaacagttgtgactgagcttgtcangttgcagtttggttttatatattctagggagacaggaattataggtaaaatcataaatctatatntagaangtntacattggttcagcctaaaggggtgggatatcttgaaggcanggtggaggggatgcttacagatcatangnnaattcaaagattttctgattggcagttggntgaaagagttaagttttgtctaaanacttgaagtcantagaaacaaaaatgcttgagtaaagataaggggggtngcgagggccaangtttttggtatgtnnatgaagcttcatagatcacagncttnngagagnatagaagataaatgtctcttttcagactttaaaaggttcagactctcaggttaatctcttctagatccangaaaagcctccaaaagaaaaggcctgactcccattaatgggggattcttnttacaanaatgcaaaatttncccccacaaaannatggcttttnccagaaccccatttcaaaat

SEQ ID NO: 4073 - DNA, 887 bp, Homo sapiens
  misc_feature (1)...(887): n = A,T,C or G
ntntatnnagctcttntctttttgcaggatcccatcgattcgaattcggcacgagactggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgcagatcaaagaccaaggcttgtaaccaaaacaagcaaaaagaaactttagctgtttaactatcacctctctaatttaaaatgcatgaaaattaatactttgtttttgtttttttttggaaacagtctcactctgtcacccaggctggaggtcgcagtgagctgagatcctgccactgactccaacctgggggtaacagagcgagactctgtcttcaaaaaaaaaaaaaaggtgtnatttggaaatggaaaatctanggtaaagggaagctttnaaaaatgttggtattttttttccctggnaaataaaacctttttattggaatttaaatggncctttgggnaaaaaaggaacntccaccattggaaaaaagggngggcctttttttatttntttttggggtagggggaatnaaaaaacccccttttgggccccnttttnaaatanccccnttngncccaaaatttggaaaagcccaattttttttttaaaatggaanggggtttaccctgggnaaatttgggttttaaaann

SEQ ID NO: 4074 - DNA, 851 bp, Homo sapiens
  misc_feature (1)...(851): n = A,T,C or G
ggnnnnnncgnnnatttagaccagctcttgttnttttgcaggatcccatcgattcgaattcggcacgaggagtatttgctggtgcattggagagtttcacgtaattcttgtgcagattcagcaagagagtttgccggcatgctttgcacagcccctggtacccagtaaggcgattattagcattggtgcttgctggaatcagatattccagaatattctgtcacagctcatcgntgccctcttcttttctgtgggtaaactgaggcagaaactcaggctgggtggaactctgcagcctcagctggagacctcgtctggccaaggactgtggggacacaggccctntaggctgccacctcatggtcccagcatgagggcaccagaactgcacagaaagtctcactacccaagtgtctgagccaggccagactgtgctagccagacctgcccggggttcattcactgacctttattgagcacctactgtatgcccagccccaaacctggctctgctcatggaaaagaacttcagtggaaacaggtcctgggatgaacaanggcctggcctggcctggtgatgccactatttctttaaagagggagagtggacaattcccggatttattgtcaggggggaggtcttcattttcttgctggtnntaaccanaaatacccacaagacttggggtcntttttagaaaacccattagaaaactnganttttcgtaccttgtttctagaagggttggggaaagtccccnngaatcaagggtggccnagccagggntntgggttgtcctgngaggggcccactanatttgggnttccaaagaanggggccccctcctttt

SEQ ID NO: 4075 - DNA, 836 bp, Homo sapiens
  misc_feature (1)...(836): n = A,T,C or G
tatncnagctctcgttcttttgcaggatcccatcgattcgtcttgactgaggttcccatctttcttanttctcttaaggatgtgctattctattctagatgcataggagggaagntaatccagncttagatcancagggctgngttctttctcagaaccatacccnaaaaagcctnantagaattttaggaaagttctatttagaaagaaactaagaattatgattaagttttggcctaagcaacttaatangcagnggtatcatttattgngaagcaaatnacataagaagcangttntggggcttgggaggaggtaagggcngaaagttngntattnttttttaaacntgtntaatntgagacacctgctagatatcctantnaaatgtcatagacacntnaatggtncacaactttgaaactcagagagaggtcanngctggatataaacagntgggagtcaancntattttatattatttaaatccanaagactggatacggcaagttnggagggagtttcaatgganaancaaaatttttgactctgnggcacttaaacatttaaagntctgataaataggagagggcccancaaagggaaatttgaaagaaccaatcatttacggtanggaggaaaaaacttagaagggggataaatatcttcaaaaaatcaaaaaaattaattggcntttttcaaagaaaaatnnaggnggnttanccccctgtggtttaaaggngnggttaaagtattcaccttggaanaaananggttcaaangggcaaagaaggcccaanngggggccctttttttaaagnaaacttttttccccn

SEQ ID NO: 4076 - DNA, 852 bp, Homo sapiens
  misc_feature (1)...(852): n = A,T,C or G
nnntntttnnantacacgctctngttctttttgcaggatcccatcgattcgaattcggcacgagcnaagctgttttatanattanggagangagtgaggagagaggaataggatagacnaaggtngagatagggancactggagaagaanacctcanagtgaggcacaggaagaggtgtgaangggaaaagaagtggcanatgtnacggaagagcccctgnccatgagaganantggngggantggnaaggaagggaagttatggggcatgggncacatagcacacaacacnacagtaaggctagagatatnaaanaaacaatgattctgagctncataagtagcnatctcncgcttaatagacatagggngtanctgtgacatggcgtnanctacagnactggacatnatcacccttttntagggaaggagggatgcctgcagnggcctaactccancangttatcatgtgctatggaagtnctgnncacaatggnggccnccantcatgtgtccaacnttaaataagnctgtcgtngctnaggacctannntgnaatcttaatttcattttaaaatntaaatnttccgnaatggangctcaaggctngcttctttttnggaaagtgtcngaactgaattgaaaccggnttnnaaaaaaaggattagtancccctggtntttccccttgtncgggggcattaaagtncttttaanccctgggacccntccccggtngggncccnttnnaaaacncccaaaatcccattggcccccattgnattttttaaaaacaatttttnaangntagnaanttntttgaaaaaaaattgggaatttggggggncccnnt

SEQ ID NO: 4077 - DNA, 897 bp, Homo sapiens
  misc_feature (1)...(897): n = A,T,C or G
cgnnnnnnnntnnnanggctttgccactaactgaaaccctttgnacccancganncgaattcggcacgaggttgaaggtatgtgtcanttttaaccaggtgttgagttatttgatntttcctncanagattatttaatagtttcaataatatctaatgatgtgtgggaaaccgtaaaatttttcatacaaactgggacaaatgaacatgcatactattaaaanactncctacaatacggcataaaangggctttcttaggngaaccaggaggtatagncagcctaatcatnngctatgantattagtnatggnaggctgtgttttatcactcatatatggaaatcttttttgaatgactactctggaaatgacgactgaatctcatactgtgtacacacntnatcanaggacacttaattgnattnannaanatanntttgaacttaccttgngttagagggncagagaggttcatnatccanaaaaattatnatgtggggctttnttcctttgggaaantgaccgntcacacnncagggcatgtgtttcttctnataccttcaccccanggggcnctttctctttnanaaaaannnggngncatgaaanntntatnattcttncccctncccnagtncnttgntnttgcttaaggnntcnnccnnantgncaaggtnnanaaanngaaaaaaagaatnntgggnaaaggcaattntcacaaacttntaaaaagccggnnatcntttgntntngggtaaanctccccnnncctanttttaanatnntnnncnnctccggggggggatattnnnnggggcnntntaanncnnnnnnanannnnaagngatnggnggngcccaannccaacganntntttntaaaanagngtaaaagcn

SEQ ID NO: 4078 - DNA, 786 bp, Homo sapiens
  misc_feature (1)...(786): n = A,T,C or G
ngnnnnnttggatancagctacnggtnaatttacttcctgcaacgncccgaatncggcacgaggttaggttggacacagaaggggcaatcaaatttctgtattcagataccttttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagaggtggcctggccaatattgaccaaggtataactaaatatgagctagcatcttcttccttcttctcgctatcccttggctttaaaagatttagtacatgaagaataatgcattagcaaaaagctcctagtttgtgtttcccctttgtgtctccctgttggctttctgagacaacctgaattttgccaacaaaatatcgcagagggatttatattaattattttttagttagatgaatattatattcttcccatccaaagtgagtgatttgctaggtttggttagggagggaaaaagcaagaataatgtgagaagaatctaaatgcgaagttgattttgtgtggnaaactggttattagttccatcaggaatttctgnttttattttttgagctattgagaagtgcatgcagatttgaaaaattagg

SEQ ID NO: 4079 - DNA, 800 bp, Homo sapiens
  misc_feature (1)...(800): n = A,T,C or G
ggnnnnntnnnnnnnttntatnnnagctacttgttctttttgcagggatcccatcgattcgaattcggcacgagggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccaaaacacgggcagcgtgggcatgtcttttgaccatctggacggtgtgtggggtcctgtcactatttggagctttgtcttatgctgaattgggaacaactataaagaaatctggaggtcattacacatatattttgggaagtcttttggtccattaccagctttttgtaccaatctngggtggnactnctcataatacgccctgcagctactgntgngatatncctggcatttggaaccctaccatttttggaa

SEQ ID NO: 4080 - DNA, 784 bp, Homo sapiens
  misc_feature (1)...(784): n = A,T,C or G
tnnnnnttttanancagctcttgttctttttgcaggatcccatcgattcgaattcggcacgagcttgcttgaaatacagaatgtccagatctactgagtcagaatttacattttcaaaagcttcctacgtgactcatgcatattaaagtttgggaagcactgacttagattaccttttgagaattccagatgggtcagaaaccagacagaaatactcagtagtgagaagctatggtgtatcagaagctgttaggcatttcatggtttggtagtgagcaagacagatagttttcctgtattcagcgacttagtctagagagagacaggatggaattaagtgtttaggtgctagccaaaagtaaagattcgtagaaaacaagggttcatatcccagtcatcaaagtgataaattttccctgcttaacatttagattaaaaagtaataattaggccaggtgtggtggctcacacctgtaatcccagcacttttggaggctgaggtggacagatcacttgagctcaggaattcgagaccagcctgggcaacatggtgaaaccccatctntacaaaaaataccaaagtcnggcacggttggttgtgtgtgcctgtggttccagctacaccggangcagangcaggagaatcacttgagcctgggangcaaangttgcaatgagccaanattgggtctttggactctagccctgggcgacanggagtgaaacagtcttcaaaaaaaaaagcctntaaaactatagtgagtcgtttacgtngatccagacn

SEQ ID NO: 4081 - DNA, 790 bp, Homo sapiens
  misc_feature (1)...(790): n = A,T,C or G
nnnnnnttttatancagctctngttctttttgcaggatcccatcgattcgaattcggcacgagcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaggaagtgtaatgtcagacacacaagaaaagcaaatcagtgttgtaagcttaaagtacaatttcaaaggtcattaccaacagcagggttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtctagtatccctctagccagattgcttagtttttcgttggtaatcaaacaacagttgtactaaaggaaagtaaagctaggacctaaatcagaatcatagttgcctgcatatatggtaacaaggncgtgtgcatttgctttcacagtgatgagtgagaggatgagaanaaattatttgacatttttcttgtgggtgaatagaanacacctttcttttgtctttagggttanggnggagatactaaaaaaacctgggatgtttatcctatcttaaattngggtgggagtaataaaaaa

SEQ ID NO: 4082 - DNA, 788 bp, Homo sapiens
  misc_feature (1)...(788): n = A,T,C or G
ntatnctggctactngttctttntgcaggatcccatcgattcgaattcggcacgaggttggttgtcaactttgcattataccacccacttgtaatatctctgccttgaagaggaaaaaccaggaacatttcctagaatccccttcccgttatgatcccaagttaggatatgccagtgagaggtgctgttttagtcccttttgcctgctgtgacaaaatgacacagactgggtagcttataaacaacagaaatttatttcccacacttctggaggctggaaagtccaagatcagggtattggtagattctgtgtctggtgagggctcattttctgattcatcgatggcaccttctcaggggtcctcacatgcggaattgataacgcagatctctgggatctcttttataagggcactaatcccattcatgagggttctgccttcataatctaaccacctatcaaaggccccatttctagtaccgttaccttaggggttaggatttcaacatgacctctggggagatacattcagcccatagcaggtactcacaatagaataagaaggcaaagcaaggaagcttttattctcaggatgtgggaaagcatcacccacttctccagtaagttgtggncgttttcaatttctcaatttcttcaccagcttccacttttgcagttgtgtcagccaatcaacgacagctttccaaaanttccgtgcaagtgcctgcttttganggcaaaggnggncataaaatnggaagcttcttcaggctccttccacaatctn

SEQ ID NO: 4083 - DNA, 889 bp, Homo sapiens
  misc_feature (1)...(889): n = A,T,C or G
ggnnnnnnanngnnnttttaatncttgctactcgttctntntgcaggatcccatcgattcgaattcggcacgaggaggaagcatataccacagaacattggctggtcaggatatacaaggtaaaggacctggataatcgaggcttgtcaaggacataaatgtnacgtccagctctnatatgcttcgcactgagcacatcacatttaggacgttgaagattttttttttttttttaatatgcannttgtaagaacaaaactggatggcatcanaattgnctggaagttttgtcttgggccaaatgaaatgatttttataattctaaacaggttaccaaatgaaatgtcatggctttactttggtcaattaaaggggggaattttttttaaaaaantgaaatgctnacacttatntctgnaaantatatngaaaatgnataccntggngcctattgangnttttggngggtcantttcnnnttacccnnccnccaanttngaaactttnttnnttttggnccatcccaccccttttgcnnnggcnnttaantnacaaanttgctttttttcccntnaangtntgggaaaaaanactttntccttnttnctttaaccccttttcnccccngnggtttcttgnttaaaaannttcctntnttaaaaatagncaactcttttnttttnttttnaangggntaccanaaaaaaaaaaataggggggggtttntaaaanatgggattggccccnncnacngggaacccaattgggntcccttnnaataaaaccttttttttnccaanatnaangggggcctttttcgcntcnantnnngcggcttanaaaaggggcnntancccgttgtttcttttngggnaaatcgcancccttc

SEQ ID NO: 4084 - DNA, 828 bp, Homo sapiens
  misc_feature (1)...(828): n = A,T,C or G
ntgnntttttattcagctacttgttctttttgcaggatcccatcgattcgaattcggcacgagagggggcgggcccgtacgccgattccatatgggcgccggcgcggagcgccgcggggcagcgcggggtcgccatggctgagctgcancagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcacagctggacagttgtgtgaccaagtgtgtggatgaccacatgcacctcatcccaactatgaccaanaagatgaaggaggctctcttatcaattggaaaataaaagtttttgccagtggccatcaagggcttgagggcaagaatatattttttattagggaaaaaaaaaaaaaagcctnttngaacttttagtgagttcgtattacgtanaatnccagacattgataaggatacatttgattgaggtttgggaccaaaccacaaccttggaattgccagnnggaaaaaaaatgctttttttttgtgnaaaatttgnggaatggctatttgggttttanttggtaaaccaattattaagcttgcaaataaaacaaggttnan

SEQ ID NO: 4085 - DNA, 789 bp, Homo sapiens
  misc_feature (1)...(789): n = A,T,C or G
nnnnnntttanancagctcttgtctttttgcaggatcccatcgattcgaattcggcacgaggttactttctttctcacacaaaggaaaaaagagactatctttagggaaacactgctttaaatcatcttccttgaatattaattctctgttgcttcctccaaaaatggagaaaataatccctaccctcataggcttattataaggctcaattatgataatggtgtgaaaactttgaaaattagacttcagagaaattgagttaatctgggattatttatcaatgtcttagtaaccaaaagtttaaaatgtgttttgtctaccaactggttgcatgtacatggttaatccaaaaggctcagcttttcagcaaatggaaaaagattaacttctttatggatcacattatgagatgaaacacatttcattctagctgctgaaaaaatagcaacatgtttttgaaaccattgtgattttgtattgcagtcactaaaacatcaaatatatcatttttatgttaaagtgccctaatttgtgttgttacataaaacttggagtaccttggccaaatagaagaaattaatgtgccgcgtgtctgttttaaaagaatgaaatctgagcccagtgtgangctcatgcctgtaatcccacccctttgggaggcttgaggcanggaaaaatgcttgagtncangagttggagaccancccggccacatanggagaccttttctnttccaaaaaattaaaaaattgnccgncatggggggcccatgccgtgtaggncccnct

SEQ ID NO: 4086 - DNA, 775 bp, Homo sapiens
  misc_feature (1)...(775): n = A,T,C or G
gnnnnnttcnaatactgntcttgttcttttgcaggacccatcgattcgaattcggcacgagaaacagtctatacatgttcagtacagatgcagccatccattttcttgtccaaatattttttatctccagttggttgaatccattgatgcagaaaccacggatacggagagctgactctgtgtgtgtgtgtgtatactcaccaattctttatttattcaacaaatatttattgaatttctactatgtgtgaagcatagttcacgatcctggggatatagtagacaagctccttgccttattgagctcacattcttatggggaagggcaggttcagggccttctcagatctttgctgggcatgcacacagccctgtgcatatgctgctttgtggattcccacaatgagctgaagcttttcaaagctcctagggacgtaccattctctggcttttccttttgagctttaggttagccttttgtttgccctaatatcacccactactcaggcaggaatgaagtcaaacaattgtcttgaaatattttcaataaatgcctctggagaaaagggtttttatttttttagccctggataagatcctggttagggtaaataaangcagccttgcaagtgggggctttccnggaagcaccagacagacaaataactacagtccatgagaatgaactttgaagggctctnaccccattctgccttattaagggntggcangntcctgggggtcancaagatgggggactggttggctttcaagn

SEQ ID NO: 4087 - DNA, 770 bp, Homo sapiens
  misc_feature (1)...(770): n = A,T,C or G
tnnnnttttaatcagctcttgttctttttgcaggatcccatcgattcgaattcggcacgagggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggtgggtattttagacttcattctcctagctgtgaattaagggtaaagctcttttagtatggaagtattcatattttgttctccttggatttcactatctttatcttttatagcacattggattttgtaggagttgttttaatttttaagtttgttaaccatttttattatttttgcttttgngtttagagtaacctgaaaagaaaagaggctcttaagtaaaatgaatttgggatgactgaaagtattttgggtgnttggctttcattttactaattctggctaatgtcanncttctacatatatttcttatcctttcaagaaaaaatgatgggggaattaaattnccngtcanaaattttnttgtgataanaaatcaggggaaaaacatatttgggggtgganttctttntttttttcttaantaaannntttanttttggntntnattnnaaa

SEQ ID NO: 4088 - DNA, 774 bp, Homo sapiens
  misc_feature (1)...(774): n = A,T,C or G
taaanccgctcttgttctttttgcaggatcccatcgattcgaattcggcacgagagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctcccatgacttaactgttggatttgaaaggaaaacgtaggatttgctcttgnccccttcccccacaaaattttgataatttgtttaaaaagggagangcngaggaaaagactngaaccttaaatngctgctttanggtttgccagangcccatacttaacattagttcttaaaattcganggtattttactaatgnaattaatcaacagagccccnagganttttttatggn

SEQ ID NO: 4089 - DNA, 844 bp, Homo sapiens
  misc_feature (1)...(844): n = A,T,C or G
nnnnnnnnnnnttntatanatacagctacttgttctttttgcaggatcccatcgattcgcttgttttaaagataattgctagatttatgttttagctttccataaaatgtaataacataaaataaaatataaataaaatatgaaataaaataaaagccatggggaaaaggtagggtttgattgctaataagaaatttcttggaaaagagactagctctcttttggttttccaaagtccacattttataacatttttagtgcttggtgtttgcttgtggtattacattagataaaaatgtatcacagtgttggtttatactggatgtttaaataggattcattgaaaggggtgtgttttctttctgaggaatacttactcagcattttcttcagaaagttacttgctgctaatcctttatggaggctctaggggaacatcattttcttgccttttccagcttctacaggctgtccacatcctcagctagtggccccttttcatcctttttttttttcttgaattatgagattttttgtactttgagttctgggatacatgtgcagaacgtgcaggtttgctacataggtatacaagtgccatggtggtttgctgtacccatcaacctgtcatctacattaggtatttctcctaatgctatcccacccctagccccttaccccctnacagtccccggtgtgatgttcccctcctgtgtccatgtgtgctcattggtcaactnccacttatgantgagaacatgcannggttgggntttctggtcctgngtgaagttgctganaatgatggnttccagctttattcatgtcctgcaaaggacatgaa

SEQ ID NO: 4090 - DNA, 776 bp, Homo sapiens
  misc_feature (1)...(776): n = A,T,C or G
gnccttttgaaatcccttntaacncaaacgcttggcaaacnccctttctncangcancccntgcgntncgaattcggcacgaggccaaatgccggaatttaaaacctggcttntaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgtaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgccaatggcgtggggtgttgtggaaaagaacaaacgtatggttccgtgtagaaagcaacggcattatgcttcacatactggangggcantgggtgccagtagtgtcctctggtcctcctgaaaantgg

SEQ ID NO: 4091 - DNA, 762 bp, Homo sapiens
  misc_feature (1)...(762): n = A,T,C or G
ngttttaaanatacagctacttgttctttttgcaggatcccatcgattcgaattcggcacgaggaatggagttccacctgggctgttttattaactatttgcccctccgtttcttcatctgtaaaacagaaatgataaccttactattaattgtgtgaccttggacaagttacaacatctccctgggcgcgattgtcccatctgaaggtcataatagcacctgccacagaggatggtagtaaggattaaattagttaatccatgtaaattacctaggtaagtgcctgccatatagcaagtgcttggtacttttttttaaaaatcactggtatgactattgcagacacctttgccatgattggaatagctggaatccaaactcaagccttccatttccagggttctggctggtgtggggctgacagacctggatggggattcccagctctgcctctcttcagctgagcaagtcactggaacctctctgagctgcattctgttcagctgtaaaataatagtttgtactttgcaggggtgttgtaaggcaatggtctccagcctttttggcaccagggaccagttttgggggaagaaaatttttncatggacagggntgctnaaggggatgttttnaagctcccatgaggatttaatgcggccggccccggnggcttacccctgtaatcccaanacttttggaagcccaagtgngccggatccccaggtcagggaaacgagaccntcctggtaacatggggaaac

SEQ ID NO: 4092 - DNA, 762 bp, Homo sapiens
  misc_feature (1)...(762): n = A,T,C or G
ngtcatttgntngatacaggctacttgttctttttgcaggatcccatcgattcgaattcggcacgaggaggagttaaattttgaagctctttgagaaaggtaccttttcttaacatgttttaaaaataaaaatacaatggcttatttaaaatgtccctatgcatggtgaaatgttaaataccaagtggatgaatggttctcaaatatattgtaatggagaattattcacatgcatctattgtttaaactaataagtaaaatagacttcctttttctgttctgttttaaatgtgcactaaaattacctgcttgtggttagcatgggctggacagtttattgatttttcagaagaatgcttggctttgggtttttggcaatagggagcctgcagcaaattatttcatttgacaaaaaagagttattttaatcctatttgaatgtatgctatctcctttaccctccccatcttatgataaaaggtctctcttttttctcttccaggtttgcagctaaaactgtgcacagtgggtcattgatgctagtcacagtggaactgaaggaaggctctacagcccacttatcataaacactgagaaaactgtgattggctctgttctgctgcgggaactgaacctgtcctgtctcangggtaacctgcttacatctggactttanaatctggcacacaacaaaagtgcctggcatcactactgntgcctttcatttataataatagcccttcctcttgcagtgggggtaga

SEQ ID NO: 4093 - DNA, 795 bp, Homo sapiens
  misc_feature (1)...(795): n = A,T,C or G
ggnnnnnngtctttcaaatnctaggctactngttctttntgcaggatcccatcgattcgctcaagtnccancacaccggcgccgtcctggactgngccttctacgatccaacgcatgcctgnagtggaggactagatcatcanttganaatgcttgatntgaacactgntcnagaaaatntngtngggacacatgatgcccnnntnanatgtgnngnatactgtccaaanctgaatntnatggtcnctggnatntngnntcagncnnataaactgcnggatcnnncancttctngnaatncnnggaccnnnnctnngccngaatangtgtataccntctcnangtcttggagaccgncnggttgtggnnacngcaagnctgccnnngnttactnccatnttangccaacatgggtatnccantcttgttggngatanaccatcctgccntaccngacttgatgngttcgagnntnngcaaactnnnnnggcttggnattaagctgnttagaangccaagnnnattctganaatntggacctgngccttngggccataaaaaagcgnatgncnntttctnnggccaaacnatgataacctgattnccatcgatttcacccttganaatggcttcanntntaaactnaatacncaantnnttatcntcaangnggaccgnnaacgcttngngaanctttttggggggnncantnttgcaaaacnngaaangtgcccatttaaanccaaactcgcaattgngcaanttnanttcaattgcctngaataattggagang

SEQ ID NO: 4094 - DNA, 750 bp, Homo sapiens
  misc_feature (1)...(750): n = A,T,C or G
natggnttttnannatacagctcttgttctttttgcaggatcccatcgattcgaattcggcacgagacagagcgagcactccagttcaaaaaaataaataaaaattaaaaaataaaataaaataaaaaatttactaggcatccagcattcattaaggagaataattcagttaaggaggaaaagaattctgggattctgggaatttccttaaccaataaagagtatgtgtgagaaacctactgctaacatcatacttaatggtaaaagtccaaagatcagcaaaaagaggatacctggtctaaacacttccactaagcattatactggaagttctagctagtgcaataaatgaaagaatacaaagtatccagattggaaaggaagtaaaatcatctttattaacagattatatgattgtctatataaaaaaaatctgaaggtatctacaacactattagaactaaatgagcttagtgagactgcaaaataaagatcaatatatataaagcagatgattttgcatgactagccatgaacaatctgaaccttaaaaccttaaatgccatttatacaccatanacaatatgaaatncatagtgatgcatctggcaaaagaagtgcaagatgtatagtataaaaattaaaacactttgggagaactttaaaaagcctaaatgagattactatgtcagagactccagactcataccataatatgcaatcttccacctgcctaagatcagtgaatcc

SEQ ID NO: 4095 - DNA, 758 bp, Homo sapiens
  misc_feature (1)...(758): n = A,T,C or G
gnnnnnnnngntttnttncagctacaggctacttgttctttttgcaggatcccatcgattcgaattcggcacgagaggacattctcctacatagccgtatattctcattatacccagcaaatattcaatcatattatctaaggtacactccacattcagaaaaaaaaatgccctttaccatagtttttgttttgcttttggttttgatcaaagattacaggtgtgagccaccgcaactggcccactgtgttacgatttgaaataaaaaggaacctgtcaagtacccagagaatatcagaactgctgtccgatctcctgaaattgaaattaatttcctcagtgactcaatacccactgccactcactcaagccctgcaagttcaagccaaatcatcctgccaccacaggaatctgatgggtcacgctgctgcctactgaaaatggggatttgggttagtgataaaataggttaaaacacataaaataggtaaactagggtaaaatacagtaagaatgggtgagaggagagaaaaagaaacttcantttaggaagcataatactacttaaaatttcctgagaataaatttgncttctagacaacacanagnannntanncnnnnnncnnnnnnnnantnnnaaaaaagcctntaaactntaggagtcntttacgnaatcccnacntgtnagatncttgatganttggacaacccacttgaatgcagngaaaaaatgctttttgngaaatnggagctttgn

SEQ ID NO: 4096 - DNA, 771 bp, Homo sapiens
  misc_feature (1)...(771): n = A,T,C or G
gnnnnttttnaanatacaggctacttgttctttttgcagggatcccatcgattcgaattcggcacgagacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaactctttctcctggctgatgaggtgtaccaggacaacntgtactctccagattgcagattccactccttcaanaangtgctgtacnanatggggcccgagtacttcatcaacgtggagctcgcctnctttcacttcacctncaaaggnctncatgggccnatgtggttacanacgaggcttcatngaggnnaatcaacctgcccctganatcaagggccanttggtgaaactgctttcggnnctccttgtgccccncaatatntggtcaaggccgcnntggacatttttngtgaacccccttggccatgcctnaacttcaaaacaattnaaatgnttttttttttggnnncaaattanaacctnacttanttttgcca

SEQ ID NO: 4097 - DNA, 757 bp, Homo sapiens
  misc_feature (1)...(757): n = A,T,C or G
gnttaanncntnatacagctacttgttctttttgcaggatcccatcgattcgaattcggcacgaggctgctgggcctggaagtccaggtggggccactcgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccggggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccnggtgtggttgccggtgcctatagtccaactactgagctnaagcnggaaaatggtatgaacccaggaagcggacttgcggtgaacccagatcgtgccaccgacttcaacctgggcgacagacaagaattcatttnaaaaaaaaaaaaagtagtggacaaccctntactatgtttatcttgggaaaaaaaagtnggtnnaacggncaagccttgtgaataaccctgtaatnccaacn

SEQ ID NO: 4098 - DNA, 762 bp, Homo sapiens
  misc_feature (1)...(762): n = A,T,C or G
gntttanancagctnntagctacttgttctttttgcaggatccctcgattcgcaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggtgttggatgtcaatgatgatttttctgaggaagtaaccaaacaagaagacctcatgagagaggtaaacacctttgtaaagaatctgtaaccaataccatgatgttcaggctgtgatctgggctccctgactttctgaagctagaaaaatgtngtgtctnccaaccacctttccatccccagcccctctcatccctggagcactctgccgctcaagagctggtttgttaattatngttagactttgccattggtttcttttgtcctgaagcattttgaaaataaagttacttaagttaaaaaaaaccaaanaaanactcgagcctctanaactatagtgagtcnattacgtngatccaganttgatnagaaacattggtnagttnggnaaccacaacttgaatgccncggaaaaaangccttatttggtaaaattgtgangcnattggtttattcgtaacctttttaaccggcnttnacaagttaaccacnaccattgctttnattttatggtttagggtcncggg

SEQ ID NO: 4099 - DNA, 818 bp, Homo sapiens
  misc_feature (1)...(818): n = A,T,C or G
tgnnnnnttnanaancagctcttgttttnnagcangatccctcgattcgaattcggcacgagcagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaancaggagaattggttgaacttggaaggtggaggttgcantgagctgagatcgcaccactgnactccatcctgggcgacagagcaagactgtctcaaaataaataaatnaataaataaatnaagttcaaaaaaaaaaaaaaaaactcgagcctntaaaactattantgagtcgtatnacgtagatcccagacatgataaaaataccatttgatgaagtttgggaccaaacccccnccttggaattgccggtggnaaaaaaaatgccttttttttggggnaaaatttggggangccttttgcttttaattttgtaaacccatttnttaaagcttgccaataaaaccaanattna

SEQ ID NO: 4100 - DNA, 821 bp, Homo sapiens
  misc_feature (1)...(821): n = A,T,C or G
aanncnggctactngttctttttgcaggacccatcgattcgaattcggcacgagatccaactgtggcttctcccaggaccattacacttgtatctaaatacctacttgacatcttcttttggatactgaataaagatcttgaacaaacaaataaaaacagtaggttgttgatgcatgttactttgcccaatagatatattctatcagaatgtgatttgtatatataatatgtttacatattaaattttgattcaattaaaattctccacaggggagattctgtggtaagttctttcgtaaatgaagtaattattctagtgatttaagttcatgttacttgtactttatgctttattattgatgtgttattatgcagtatgcttatttgtgttttattcttatgttatttactcttgtttctgattgatctttcatgaagctcctaatactctgtccatagaagcacagctataatgatatttacatatgtaaggaagactacaaatatttcttcttttgattcatttttggtgattatctccttggcagacataaaagactgatgtggtttggctgtgtccccacccaaatcttgaattgtagctcctctaattctcacgtgtcatgggagggacccagtgggaggtaactgaatcatgggggcaggtctttcccatgctgttctcctgatagtgaataagtctcacgagatatgatggtttaggaatggggagttcccctgggcatgctctctctcttgcctgccacctgtagacgtgactttgctcttccttcgtttntgccaagattggngaggcctc

SEQ ID NO: 4101 - DNA, 818 bp, Homo sapiens; identical to SEQ ID NO: 4099
  misc_feature (1)...(818): n = A,T,C or G

SEQ ID NO: 4102 - DNA, 845 bp, Homo sapiens
  misc_feature (1)...(845): n = A,T,C or G
gnnnnnnnnntttntatagatacagctacttgttctttttgcagggatccctcgattcgaattcggcacgaggatacatccaaatattattcatgttatagtaaatcagatgaagccttgagcttctcagcagccacgtaaggcttaaatatgagggaacaggggctcttagaagtgaagtgacttctgaaagatgcacagagaattaggaaagagtctgaattcaaccctggaaccctgactttcaggtgagtgcctggcccactaaagaatgacaaagccatggggagtggcatggaaagcatgagctttggagttagacaggcctgggtgtgaatcctggtcaccccagttctgttaaagacctcagaaaagttacctagcttcattaagcctgtttcttcagccaaaaattaatggtgttaacgcttacctctcaggatgggggtcacaaataaatagaacgacataaagtacataatacatcaatcagttaggatgtatttggctacaggcaaaagaacagccctcctcaactggcttaaccaacaattaacctattatcttacataaaagggagtctagaagtagggatgttccaggtttggctaatccagcagctcaaccatgtcaacacagaccgggttttctctgtcttgcctttttgccattctcagtgctttcatgggctccctttatgcttgcaatatgccagctgcagcttcagacatcaacttntcacatacctatgtccagagcagaagaaggacatttctccttgngcatttctactggagactaaattttcctgcctggcaaaaaaaaaaaaaaaaaaactcgnnccn

SEQ ID NO: 4103 - DNA, 830 bp, Homo sapiens
  misc_feature (1)...(830): n = A,T,C or G
actacagctacttgttctttttgcaggacccatcgattcgccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttggtttgaagattcactcatgttgcatgcatctgtagcttgtgccttttttattgcctagtagtattctggcatatgcctatcttacaatttgattatctattcacctgttggatgaatgtttgaattttttccatttgaggaatttatgaataaagctgctnttagcatgaaaaaaaaaa

SEQ ID NO: 4104 - DNA, 844 bp, Homo sapiens
  misc_feature (1)...(844): n = A,T,C or G
nnnnnnnnnnttntnaanatacagctacttgttctttttgcaggatcccatcgattcggagaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctctctaaataaggtaacttttttatacattttctttttatatgtatttattcttttttttttgtgacggggtctcactctgtcaccaaggctgaaatgcagtggtgcgatctcagctcactgcaacctccactttccaggctcaagtaattctccagctactcaggaggctgaggcaggagaatcgcttgaactcgggagatggaggttgcactccgtctggatcatgccactgcactccagcctgggtgacaaagcaagactgtcttaaagaaacaaaacaaaactacaaaccaatttgttttaaagcatgttttttctctggtaaagaaccttncagtgagtaacacaggacataaatttactatggtaattaagtcgtttttatcanatggnattattaagttggttttatcaagtggnattaaaggattcatttgtttacagtattattcaacacnaatnggaggataattacaattccttatt

SEQ ID NO: 4105 - DNA, 881 bp, Homo sapiens
  misc_feature (1)...(881): n = A,T,C or G
gnagngtcnnntttctaatgctgganactcgttctttttgcaggacccatcgattcgaattcggcacgagggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttntcatggctcttccacacagtctactgccactcanagggggtctctcggctntttctctaagtaagtatctgtaaagtncatatttttggccaatgattnanaggttagtgcnttaggggaaaaaacattcncccanantttggcatgaattctttaataatnattctaatncccnccttnannttttnaaaanaanttttnnacacnaaaccccagatttgncttntttaancatttnnttnnatttncnnanaganccnccaagntataaattcggggaanacnaaaatnggttcaatttnnt

SEQ ID NO: 4106 - DNA, 831 bp, Homo sapiens
  misc_feature (1)...(831): n = A,T,C or G
tttnnatacagctcttgttctttttgcagggatcccatcgattcgaaaaggtgaatgcagaggcctggcccagaccccagccctgtgtgtcaatacaacttttcacgttgttacatacacattttccagtctgtgtctccctctgaaagaaaccctgaaattcaggttgctaatagattgttggttgcaagtatgaaggacagaggaggtaagagaggaggcaacttgctaatgcaaaagcagtgtactgaaagtcacttttatttcttatttataatctacatgcacactctggataatagatgacactgctcattcagtactttaacttcaaagcagagagaagccatggatgacagagccgggagcgggaatacaaaggtactaacaacaagaggaaaaatgcctgtttacgggattgcatttgttagcacgctctcttcagatattgttcccccaggaatagcgaaaatatgtgcagcgcgaacaatgatttaacatctgaaaatggtacttaaagagtttctgtctggtagtaatgtgatggaggcttctgaagggaacctggggacttcatttcttctatttatctatatgtctctctggttttagtgagcggtaattgcatatttaacccctcaaatagctttaaccctnacgatgccactttttaccctgtataaaatgtacttttatcccagcaaaggcagactcagaaattnccttacccaaaaaattatttaaaaaaaaaaaaaaaaaacttcgagccttttanaactntngtgagtccgnnttacgtagatccngaccttgatnaggatccattgatgn

SEQ ID NO: 4107 - DNA, 848 bp, Homo sapiens
  misc_feature (1)...(848): n = A,T,C or G
gnnnnnnnnntttnnaactttgctaatncttggctactcgttctttttgcaggacccatcgattcgaattcggcacgaggcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcaacctttgcctctaaactgcctggaaccaaatgtcgatttttctgacccctcccagggagtgctgagtagtgatggtgtctggagggtcaaatccattcccaatggcaaaggttcctcaccactccccaccgctacaactccaaaaccactcatcccagtgtttggggcactgtgttcctcttcgtccctgcaccagaccctggaagccttggccagagacctcaccagactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaaaaagcctctagaactatagtgagtccgtattacgtagatcagacatgatnagatacattgatgantttggacaaaccccactnggaatgcantngaaaaaaatgctttatttgtgaaatttgtgatgctattgctttattgtaaccattattaagctgcaatan

SEQ ID NO: 4108 - DNA, 849 bp, Homo sapiens
  misc_feature (1)...(849): n = A,T,C or G
gnnnnnnnnntttnaaccttnctaatnctggctactngttctttttgcaggatccctcgattcgaattcggcacgagagaaaccagnatcacacaggaatgactgggattttaggcctggaatgtacctttaaaattatcttattacacaccatccttcatttttctcattttcctcttttgggattcatatattaagtattagggcattaaaacacaactgtatatataaagaaaaatataaagtaaccacacatgctcagggaaagacacaggctcagaaaatgcctgagaagaacttagtttcacaccccaggctgatcctaagcaccgagacagcctacaacaatccaaaaaacaaaaacaataaataaaaagtaacaaacaacagcaaacctaagagaatgacgaaaatataatttccagaattaccactttattagagtcaaatgtccagtttttaataaaactcagaagcatacaaagaaacaggaaattatggcccatcaaaggatcaaaggaaaaaaaaatgaatggaaactgtactgaaaaagacatgatggcagatatactagaaaaatactttaaaatactgtcttaatgatgctttaaaaactagaggaagatgtggaggaagtcaagaaaatgatgtacaaacaaaacagcaatatcaataaggaggtagaaaactttaaaaggaaacaaaaaaattctagagtggaaaagtncaatactgaaataaaatattactagtaggattgaagtcatgtttggaataggcaaaaaaaaaaannnnnnnnnnnntnnaaaaaaaaactnggccttttaaactttnggggtcngtttacct

SEQ ID NO: 4109 - DNA, 835 bp, Homo sapiens
  misc_feature (1)...(835): n = A,T,C or G
tannccngctcttgttctttttgcaggatcccatcgattcggtttggcagtctctgaaaatatatacctgccatatgatccagccagttcactgctacctagtttcccaaaagaaatgaaaatatatgtatatgtgaatactcatatactaatattcatagcagctttgtttgtaatggacaaaacaacccaaatgtccatcaacgttggaatggaaacaacccaaatgtcaatcaacaagtgaataaacaaaatgtgctatacgtatataatggaatactactcagcaataaaaaggaatgaaaggaatgaactaatgatgcatgcaacagcatggatacatctcaaaataattatgctgaatgaaagaagccagacagcaaaaatttcctactgagtgattccatttatataaaaatctagagaatgccaattagcctttagtgaaataaagcagaacagtaattgcctgtgacagggtgggaaagatttggactggaagcagggattaccaagaggggtgagaaaacttttgaaggtgatgaatatgtacattgtcttcattgctttggatggnttttccagggtgtatattgtaatttcaaaaaatgatcaaaatttntacacttttaaaatantggttcaagttttattttttatattgaaataaaaggctggattaaaaatggcccnaaanannannanactnttnantntntnnncncntnnntnncnnnnnnntcntnnnnnnntntntnnnnnnncnnccngcnccttnttaaaaantttngnggggggncgntttttccntngaaccccccnctttgttttanct

SEQ ID NO: 4110 - DNA, 772 bp, Homo sapiens
  misc_feature (1)...(772): n = A,T,C or G
acattnngnncgcctttcngtttgancccatcgaccgaattcggcacgaggctngatcgtctgggcctgngtttnanctggnatnggatnctcaatccttnttgttcaaattttnaagtccagaaagctctgaaaactgaaagttttttcataatttatttcactgtaaaacctgaattgaactgatatttatctcactaaaaatgagtattcatatattgnactgtangaatngtaaaattaccaagtantancccagacctagttagataaatgcacnattngcttttaattncaaaaaaatcttaantctgaggcacatttggctgacagcatttcagatnagggattttgaacctctaattcaatgatgtngataaatatcaccacttctactaccattgtctattactgaacacttaccatgggccaggtacagagaaggaattgacctaataagctnttcggnccntananagctntaaaaggcaggtccttttattgacgtcattttattgctggtcacccaagtggcaaggctgggctgatccattggtcaagttatgactgccgtgctcctnccccaaacttaangcagaantctcagtgcagatgatcctggacttaccaagggggttatnctaaatngaataagaactgggcctaaaattgggaaanattggtaaggccttttaataccatnttaaccatcttagctttgncttaacctacccttaaanngtgcctcaaggacacttacatttaccgnacc

SEQ ID NO: 4111 - DNA, 790 bp, Homo sapiens
  misc_feature (1)...(790): n = A,T,C or G
ttttctttnnntnnatcagctcttgttctttttgcaggatccctcgattcgaattcggcacgaggggacctcgatcatgacaggctcatcagcctgtgcctgacccttctcacgtgaccccagacatcctgcaacctggggggacattcctttgtaaaacctgggctggaagtcaaagccgtcggttacagaggagactgacagaggaattccagaatgtaaggatcatnaaacctgaagccagcaggaaagagtcatcagaagtgtacttcttggccacacagtaccacggaaggaagggcactgtgaagcagtgaggatttcttgtgccattttcataatggtcattagctccttttaagctanaaacgtacctgagcttctgaagagttcctgggagatttgagctgattttggaaatggagcatgacaagtggggagtctctctctctctttctctctctctctttttaaccaaaaagagatgacnaaactaagttcaggggccatggaaaatgaaaaagtccgctatattgngatttgggaagaagaaagttntcangaagaaanangtgangattgaangatngagaaaaacagacttgttgggaagggtcanaaaggaattcccccgangcaagggattggtgtgcccatttgtgcctttgaccgggaccttcatcttattatactggttaaacttgtnanaccacaaaacaggggttttccaacccctgtttttagaaccccacgcnccagatttttccaattctttaaaggggggctggtt

SEQ ID NO: 4112 - DNA, 775 bp, Homo sapiens
  misc_feature (1)...(775): n = A,T,C or G
ggtnnnnnttgnaatcganagctacttgttctttttgcaggatcccatcgattcgaattcggcacgaggaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacnagatntttaaaaaaagaaaggaaggaaaaaaaaaacncttccttttaaagaaattccctaccngatttttaatataggtnatcttaccactttcttttctagtttcttggattttnagcttaggctgcattctaacctcatactgngnaanaccaaaggtggtttttngattcannaaattttttgaaaatctgcataagccttaaatttggtaaaaaattaangaaaaattcctttaaaaaaaaaatannnnnnnnnaaaaaaaaaaacctgnggcctttanaactttgngagtcntttcc

SEQ ID NO: 4113 - DNA, 773 bp, Homo sapiens
  misc_feature (1)...(773): n = A,T,C or G
ctaatcccttgtttctaatgcttggctactngttctttctgcaggatcccatgcgattcgaattcggcacgagcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctggggtcttaaggacctncctcatgtctttaaggtagcatcattgatctttggatgtggctttttggatttcttgaacaagctaatgttgtgtcaagaagcaacacttttgtgaatctcattggctttgattggatttgggcttgttcaaaaatgtttatttgaaaaacgtattcctttaataaacttaaccaaagagattttaaaatt

SEQ ID NO: 4114 - DNA, 704 bp, Homo sapiens
  misc_feature (1)...(704): n = A,T,C or G
gnnntattgcaattngatagctactngttctttttgcaggatcccatcgattcgaattcggcacgagggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcanttcttcatgctgattaaaccgnttttaaaaaacccttctttaaaantttgaagaggaaggaaccctactntccagccaaggtatgggatgatgggatcattgtccacagacncagactgtcttggtctngtttagtgcacctnaccccatngagagatgntcgttcttagatgtactggataagngttctgtgaatnctgaatacctgngtanctaaattaacttcnctagtgtcanat

SEQ ID NO: 4115 - DNA, 758 bp, Homo sapiens
  misc_feature (1)...(758): n = A,T,C or G
gtnnnntttcaattgnttaggctctcggttctttntgcaggatcccatcgattcgtttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaagctcaatagcatctttaacgtgaaaatnaaaccagaacncnannaaggcctttanggatttcngggtttttgcccacggccacaggttcatntccagaggaatgcaaaactganacnatccaggaagagctaaaacatggccctgtaataaatgaccagacctttcctgnggttcaaattnttaacacacttcctttcttttgggaaaaaaaaannnnnnnnantnnnnnttnnaaaaaaaaaaacttgacctttaaactnnaggatcttttactnantccaacttgntaganccatggtnagttggnna

SEQ ID NO: 4116 - DNA, 869 bp, Homo sapiens
  misc_feature (1)...(869): n = A,T,C or G
ggnnnnntnnnntttgaaaccttnggctacttgttctttttgcaggatcccatcgattcgaattcggcacgaggtcaacctctaccacgtgcgggaggatggctggatccnagtctccagngacaatgtggctgatctacatganaagnatantggctctaccccctgaaagagggtggatgcanctgcttgtgtatnttggggtgactgtcattggtaatacggacacagtgacccatcctccatnctatttatagngnaagggccttcantngtatcagtacttgatttnaagctctggcacattgacctntatgtgttaccagtcattaatgagctgntgcacgaggtgactattngttanactntcttagcatgttaacattacactnctcactactcatananaagnntnnnnanaacttgagncctttaaaaacttttaagtnagtcannatttccgttngattccaatancttngaatnaagaatncctttgggntnaatttttggaatcaaaacttcctacctttgnaaattnncnntgtggaaanantaaaatntgctttaaaattttnngttgaaaattcttggggggaancgattttttnngnctttnnaannngngggttaccccctttnattannntcttnaaatanttnccaaannttttaaccctcaacctttttggnnttttantttttaagnggttncatgntaaaangtnaaatntntttgtanngntttttttntccagntnccnngngttcttnanaaatttngcccnnngtgtcnacaanntnttttgntnccntaatttatnggnngttttnttnccnctnttgtcataaaatagngttaanctgnn

SEQ ID NO: 4117 - DNA, 817 bp, Homo sapiens
  misc_feature (1)...(817): n = A,T,C or G
ggtnnnnnttttnnnntacagctacttgttctttttgcaggatcccatcgattcgaattcggcacgaggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaanggtctacttattgtccgacaccatngaantnttttgagggttgcnaaanaccattgaaaaaagaacnaaaagccttaaaagccctgtnttcncttgtaaattcacctgcaaaaatatggattggctntttaccaacngggcaaccctggcaaaccnaaaaaggcttgtgggnatttggaattatttggtnccgaaaatngtctcntggtaanttattcattacttacttnaaagaactggtttcaaaaatnggcaagcnttccttnaaaagcccagtttgttaaaaaatanggtcccccttgncttggttccaaaannaaaaggccnnaanggaantttccnn

SEQ ID NO: 4118 - DNA, 861 bp, Homo sapiens
  misc_feature (1)...(861): n = A,T,C or G
gntnnnnnnttgtntncatacaggctacttgttctttttgcaggatcccatcgattcgaattcggcacgagccggcttcctcatcaacctcattgactcccccgggcacgtcgacttctcctcggaggtgactgctgccctccgagtcaccgatggcgcattggtggtggtggactgcgtgtcaggcgtgtgcgtgcagacggagacagtgctgcggcaggccattgccgagcgtatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctncacgggtgggccttaccctgaagcaatttgccnaanatgtatgtngcccaatttngccgnccaaggggggaaagggcccanttnggggccctgccnaaacngggcccaanaaaaggttnanggaccattgaattnaaaaaaaaccttttggggggttgaacaagggtncctttttggacccccaanccccaaacggggcaaaggttttnaancnaagggttnaagcccaacccaaacccccccnaaaaggggnaaanaaaacttggccaangccaaccnttttttggccaaacttggaacccttgggaanccccatttttttnaangggngttttggatgccnaaccattgaaattttcaaggaaaanaaggaaggccngggattngggaaaaccccaaaaaatttttttccattttttttn

SEQ ID NO: 4119 - DNA, 851 bp, Homo sapiens
  misc_feature (1)...(851): n = A,T,C or G
ggtnnnnnttgtaanntanagctacttgttctttttgcaggatcccatcgattcgaattcggcacgagcctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataatnaatatttattggatgcttnaaaaaaanaaaaaaaaaaaacttnnggnctttttnaaatttttaggggagtcngtnttnccntagantccagacnttgtttanggatnccattggttgaanttttgggaccaaacccncaacnttggaaattgccnnntggaaaaaaaaantgccttttantttggggnaaantttgggggaatgccttatttggcttttaattttggtaacccnnttttttaaagcctggcaatttnaaccnaggtttnaccnanccaaccaaattggcattttcatttttaaanggttttnnanggtttcaaggggggnaaggtttttgggaaangtttttttttaaaatttnnnggggccccnngggngccncna

SEQ ID NO: 4120 - DNA, 848 bp, Homo sapiens
  misc_feature (1)...(848): n = A,T,C or G
ggtnnnnatttaanntnagctacttgttctttttgcaggatcccatcgattcgaattcggcacgaggnncctgcaagggctggtgtggaaacaagcannntngntgcntgaagcaaaagtnanacngnggtgtnnactgttgatgtgaccccacaaagtgtnggaaccgccatcaaggcnnggntagctngggcactgtngancggacccanaattncnnnggntccttcnaactgnangatcctaccnaggtnacccnnggatngngcttntntaatncnntttgtgcnaccccnaatagcnngatcctgaaaganatgtgccatgtngancaggtgctgtnaaagaagactgcttcngctccctgnccttttgacctcccngagttgaaacatgtagcaacacgnntnccatagaatacaaggctccagntgaagaaaaagaaacgggntctggtcagnaacaatcagnttccntntcttggangattcccctnttntaatnaaaagccctnatttnanttttnnangcnttnaattttttacncctncaatntttggtttgcntaanatgctttttcaaggtttganaaccctttaaangggggttttttttnaaaatggactttcttntgggattttnagggttttantttggcttanttnaaaaaaaaagntaaccaaaaaccgtttncttgnaaaaagaanggtnnaccctttaaatnggatnttgggccctttaancctttcaatgttccanggnttacctnacttttangttntntcccaaaaaaanggttnctaangtntnccttatttggactnnaanaacccnaattgaacttttnn

SEQ ID NO: 4121 - DNA, 756 bp, Homo sapiens
  misc_feature (1)...(756): n = A,T,C or G
gnnntttcaatcganagctcttgttctttttgcaggatcccatcgattcgaattcggcacgagtacatatttgtcataattacaataaaatacaaagagctattttggaactgggcaagctgtttctaaatgtatatggaaaaataaaaatgtctccaaaaaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtggaaaacagtttgtagagcttcctcaataaaaacacatatgatccagcaatcccactactgggtatatatccaaaggaaatgaaatcagtatgttgaagagatacttncacgttcactggaaccttgntcacattggccagnacttaaacctaaagggtccatnaaccggaagatagatagggctgaccgcggtggcccacgcctgtaatcccagcactttgggaggccaaggcaggtggatcatttgaggtcagaagtttttgaccagccttggccaacatgatgaaccccgtntttctaaatttccaaaaattagctgggcgtatggtgggcacctgtnttcccagttctcggaggctnangcagganaatgctgacccagggacggacttgnt

SEQ ID NO: 4122 - DNA, 775 bp, Homo sapiens; identical to SEQ ID NO: 4112
  misc_feature (1)...(775): n = A,T,C or G

SEQ ID NO: 4123 - DNA, 770 bp, Homo sapiens
  misc_feature (1)...(770): n = A,T,C or G
gnnttcaaatcgatagctacttgttctttttgcaggatcccatcgattcgaattcggcacgagggccgttgggcgagatgaagctacactgtgaggtggaggtgatcagccggcacttgcccgctttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgctgaactctttcattcaagggactacttccattgaatttggattntgtttgccccacattgggggtcttantananaatttggggtggnncntgaagcacctattaatctcttaatttctggttctcttangctggttatgttaaattcctccgatatgttaaaagtaatgggtgagaccagaaaaagaaatttcaattaccagatcantttggggtgcattgtatgattttgcaccntcaaaatggaattangggaagaattctggntcttgcttggaaaggangatgtgtntagntncccatttanatgactccaaattttntta

SEQ ID NO: 4124 - DNA, 707 bp, Homo sapiens
  misc_feature (1)...(707): n = A,T,C or G
gntnnnnntttgtntncatncagctacttgttctttttgcaggatcccatcgattcgaattcggcacgagggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaacccaccggcgacttgcccttcactggatctgccaccctacattcggccggggcccaagganganaaccagganaaagcagtcccccaaaaagcgggccttgnaggaaaaggangtggcacggangtctgtcttanacccnttgcaaaaggacaataatatttaaagtgaaaaananannnnnnnnnnnnnnnnnnnnnnnnnnnnnnnnnnnnnnnnnnnnannnnnngnnntnnannttnnnnnntnnnnnnnnnnnnnnnnnannnnnnnnnntnnnancnnntnnnnntta

SEQ ID NO: 4125 - DNA, 673 bp, Homo sapiens
  misc_feature (1)...(673): n = A,T,C or G
gntnnnnnnttttatatatacaggctacttgttctttttgcaggatcccatcgattcgtgcttgttcgtttctgtgtacttgcttagtggactgtagcaacacactcagcttctccagtgtcaacccacattggctttcccactctacagtttctgtaggatgcatgttttcaccattatcaggcttctgcagtgctcagagggcagcaatacccagcaaccagtgacccgaggccagcaacttcttttacttccccctcagttggatttgtaacagagtatctttggtgggacacttctgtgtgaagagattttactagcaccctaaagaatggatttctggcaagttccacaaggtagacttccagtaagttctgctggtgcagcactacagcaacttccgtgctattcagtgagaggactgtgttctctccaacaaggtctggatctcagccctgggatggtttaaggtcngangaagctnttgctttggggntctgngnnaanctnagggacttnggnactntnaanagtctcttattcnnatagtnaatanctgttctcacccatgttaatagtagngacctttataagttcatttcaatactggggttcttcgatgnttcttcttattagacgtgaaatgtgatgtgattgtatagnatgntacata

SEQ ID NO: 4126 - DNA, 753 bp, Homo sapiens
  misc_feature (1)...(753): n = A,T,C or G
gntntnnntttgtatanntacaggctacttgttctttttgcaggatcccatcgattcgcagcaatgttttgtggcttttattgtacaagcttttcacctccttggttaagttagttcttaagtgtcttattcttttacgtgctattataaatggaattattttcataatttccttttcaggttgttaattattagtgtacagacatgcaactgatttttgcacattgactttgccagtgacatgaacctgtatgtagaaaaccctaaagattgcacaaaaaaaatggttagcttgagacgtaaaccttaggcaaagagaagtttgtgatttgtaagaaatttaaaattaataggattaaaaagagagctgtgggccttgttatgtatttgctttggaagccctctaagaaaatttcaggtcaattttttattctctgccctactggaatgcccccagattatgtgacaatgangtcttattttaatatgtncanaatttggtnanantggcaatnnttgggttcnanattttcccatttcagaaaattntngctttttcnggtgatgtcttatcctcttgngtgggtcccaagtgagccctgatcctttcagatncattttatatactctggtggtgatgaatatttnatctctggcaaatactgnccatgctaattccctggaggacctnggatncaatattattggaattntaaatcaaggttaacctaagtcaaagagtctnanctgccc

SEQ ID NO: 4127 - DNA, 817 bp, Homo sapiens
  misc_feature (1)...(817): n = A,T,C or G
nnntntnnnttttntacatanangctacttgttctttttgcaggatcccatcgattcgaattcggcacgaggcgagggcctggcccccagggcggccacaccagaaggtcggagaaaggcccaaggcggatgccacgcccagcagtggtgagggacccacagattttggaaacgacctggacacactattgggaaggagatgtggacggcctgtctcctcctgcagggcccaccctaagaatgtatttttaaacacatgaaataagtatttttcactgataaaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatggtttnaaggttaaggggaagtttttggaaaggtttttaaattcnnggccnnggnnccaattgcnttgggcccggttccccaanttttngttcccttttattgangggttaattgccccccttgggcgtnaatcatgggccataancttggtttccctggggtgaaaattngntattnccgtttnacaatttcccacacaanntttncnaancccgggaanccttaaaantgtnaaaaccctggggggtggccctaaatggaattgaaccttaacttnacatttaantggcntttnnnncttnaattggccccntttt

SEQ ID NO: 4128 - DNA, 684 bp, Homo sapiens
  misc_feature (1)...(684): n = A,T,C or G
agnnnnnnnnnnttgaanacnnnagctacttgttctttttgcaggatcccatcgattcgaattcggcacgaggataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgntggaatactggtagaaataccttccttcctcnttgccanggaaaaaaaactcccgattatncngntataaataggaatttgtacatattacattttaaaatttaaatgcatatatttgaaggatggatatagtctgagctatgctgcttaattcactcctggaccgncaatgttttatatggctgctatgctggtacgngctgatgnaa

SEQ ID NO: 4129 - DNA, 779 bp, Homo sapiens
  misc_feature (1)...(779): n = A,T,C or G
acganagctacttgttctttttgcaggatcccatcgattcgnnnctanntcgagaagaggtntggtnacctnctgntgcncncnctgggctggacggnaagangactnntnnntcnanggngngnnnngcggcacaccnggtatttgancatgcattatctncacacactgtgcagcatcctttggagagcacaacgcatggaaaggtcatnnannntntganttgccatntcnntngcgngtcntcctacccaagtaaaagntaccttggcnatnntaccnccgntttnntcactcncnaggacntattacctngggtgcntnnaacgtaatcnnntactnnnnctcattctnacnnnnnttggacccatngncttgctgncacacctatgaagnactgtttcacagcnctttcacttcctacnaaggtaccatgttatttatcttgcctngaaaattctgaattntacncttaaattttaanntttnttnactntnaangcaaaaattttttgaactgaaaggtcnttaaaggcntttngactcttcatttttcaaattngggaaaacaatgctcaaaagagttntnttnaccttngtaaannaangggaanaanaatctggaatctttcctgancctntacnttaacctcttntnttcactggtncttgcanttttttcctaagtnatttnntngggattatttnatttcaaccaaacacttganccctttttanngccaatgcacttggttaaaccatgggggnaaaaatgcccc

SEQ ID NO: 4130 - DNA, 779 bp, Homo sapiens; identical to SEQ ID NO: 4129
  misc_feature (1)...(779): n = A,T,C or G

SEQ ID NO: 4131 - DNA, 758 bp, Homo sapiens
  misc_feature (1)...(758): n = A,T,C or G
gnnnntttcnaaanntttttgaaanccttcttnncctttcaaancgcttncgaattcggcacgagcacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctncagagcgggtgaggacagagcagctgtgggcttttcattctgaggtcttggcccccctgccaccgcaagggactctttgcttgtcagggcttgcaaaaaccaaccttcgagaaagaaaagggaactcttcacgttgaatgttgactttgtgtgtatgcctgtgtgtgtgtgtgtgtgcacgcgcgcgtgtgcgtgtttacttcatggaattttgttttgtgaaattcccctcaatcgtgtcagaatttaccttcatgccccatcacactgttggttctgcgctctgaacctgggtgtagctcatttgaangactctcttctgcgtttcctaacagttatttggtggtctcaaaagttgangttgtggaagggttgggaagaaactgaagttctatccatttccatagaatttacatnctgcatttnaaangcanggaaggcttaaccccggcccaaaacttncaggcct

SEQ ID NO: 4132 - DNA, 1335 bp, Homo sapiens
  misc_feature (1)...(1335): n = A,T,C or G
gccctttctaantgctnagacccttgtactcctcatgaacgtttggnaaatnccgcacgaggaaacagacaaatctgtaataacggcctaancctntttctgngatnagnntcatttttgcccantcnnaaaaaatgtgnaatagnttattcaagncaancagctcattttccaacaatcctnngctcatgtgatcccccaatncccacaactttntgganaacccnngggccncanatggttgtggaaaaatggggttntagatgggttcgnggaacttgnagggtatgaaaaagggnccannccaggctngaactggggattnggannaaacnccaatcgnaaaaccnntttttaaanaacnccccttttaanaagggggcacctgntntttaacggctaaganaaaatttggaattgcccccctcangttncatnnaaacggggatttggaaattttggaaccccctgggggnnannattatcccatccacaaannggaaccctgggggcancncccaggggganctttgggaaaacaaggggggccccttggccttttaacggccgngcctntttttgggcantaancnaggctngccctaanaangggggccnccctttntntaaccncccannacctttncggcgtttcncantnccccntggngncttaaacnctgggntgcccntgtctatnncnagacccctttttngcccntggggggncnantttaagnccccccccnttgggaaaatntccccccaannggngnanngggngngcccnaaattttnccnncgnnccntttttgcnancntntngggccnatcccttatggntnaaacccttngnaagnntcaccaaattngggttgggcccctttctaanggtaaaaacaaaaaanggnnngggnnnccntttgncancattnncttttcccaanacnctttggnggggnaaaaaacccctgtaananncaagcnccngggnaanataaagggtaaaaatcncccnngggnncccttaaggnnnttttnaaagggaacnntaaanccccncccgngggngnnaaattccttgggcttttacncnccntttgngccncaacnntgggacnaaaggnttctnacnagggnaaatngggggggcntnaacccgaacccccnantncccnctaagganagcgntaanttaangggaancttcngccttgcaaanaaagntntttgnacaatnttngcncgaaaanngngggngaactnaaaactgggaccaaantccnccnggncctanacnttananaaaagatgntaaacaatngcccccccccc

SEQ ID NO: 4133 - DNA, 848 bp, Homo sapiens; identical to SEQ ID NO: 4120
  misc_feature (1)...(848): n = A,T,C or G

SEQ ID NO: 4134 - DNA, 768 bp, Homo sapiens
  misc_feature (1)...(768): n = A,T,C or G
cntnnttgnncnnnnnnnngggggntttgcantgcggnctaatggctnnggctactngttctttncgcaggancccancgattcggaaaatataggcctttattgtctttaacattgaagtaactttgtagttttattcaattatgagccagcagatccttagtttaggcccttatattgcatacctaattagaactttccccaaagttcaactgcatgaccttaatgtattggagcacgtcttacaggtggacttaaaactctagaatttcctgagtcgttgttattttccactgaaggtctttccactgtacagcatttcaggcatcatcactatgattcttttttcttgactgttgcttgttttcccactgctcttttccccaatggcgagctgggtgtgccatctctggggctctcttataggaactcacagtctagcctactgtattttgttttcggagaagtgaaagtgaacactgttatttgccatcatacctccatcaagaatttcacttcactaggaaatatatgggcctttcatggaactgatgattactgtggctgatgtgagtgttgggcttangatgctcacatgtggtagttggaagttttgtaatctaagatggaaatgagtgggccatttaaatggccatctaaaggtcacagtgactgcanaagaagtnagaagagagtataattcttcagctccctggacttccatangaaagctngaaaatcttatacccagattacccaaaaaaaaaa

SEQ ID NO: 4135 - DNA, 798 bp, Homo sapiens
  misc_feature (1)...(798): n = A,T,C or G
gnnnnnnnnttncgngtgggcnnntaggtgggggnnttctnttttactnatagctngtgtactcgttctttncgcaagatcccancggttcgaattcggcacgagggnaacctttcaatcactttaactagtcncttaaggactctaggcccagaagcctggtttctgggtgaatgtttttatacatcactcaacttccctcgtcctaaaaggacacctaattttgttactattgaaaatttttattttggtggccagaatacgaaatcgggagaggtaacccaaacagttgtcttaggaaaaggcagattctcagaggcaatgggctatcaacaaaataggtgctaagcacatttgtttgtaatgatcattcatataatttanaagatttatggtaacagtttatattcattatccatacagttctatttttgcaaatagaataaccacctataagcaaacagtgttaatgagaaatatatattgtnttaagaaaatagcatataccacatgaaaaagagtgttccctttctntttttttttttgccagaaatcaagtgtggaagncttgatcaaagtaaaactacctatttgaactgcacanataaaactggggtgcccaatccntattttacatttctngggcttgattcatataactttgtaanaaaaaagttnactattnaaaaagtcnngtgngccttcacttttgacttggacttctattcccctttttgtcctgggattnctttttcctacncnatttctnnaaatnttatgaaangggcntntntncnn

SEQ ID NO: 4136 - DNA, 1105 bp, Homo sapiens
  misc_feature (1)...(1105): n = A,T,C or G
gaccccnttcntgattgggncnnaggtggggggttttcctttttactaaatngctngtgtcntccntantctnctnannannnagagcnnagtcctcanacagcncgnagccccantagctgggcctacaggcgcccgtcnccacaccnactnttatgggggggngnggggngggggagacggggnntttaccatgtttgcnncccgcnggtgnccncgtggtcannnctgnngaccanctnttnccggncanancncnccggnctcnntatcccncnccaggncncncgncnccntncannnntgaanncccncccccnctcnnanctaacnngnagccacngccaanttcnnntntnncgtnncantttnactacacttnttcnnctcccntnttccactctnnngncncnnncnncnnggtctnantnccntncttcttntatagacgntcatcacnnccaccnccaannttnncttcancataatcncntntancctncancncnnanntacggcctcnntctcccncccctnttctcacncttanttctnctctcctctcgcccntnctnngccnncctccnctccccctctnaatnntctnctnntctctccctntcnnttttcgntnancacncatnncatcnccaccacctcanctntatctatnatcttancntcctcntctccctcnctcatcactgttcnacncctnctcacancannnatctcctctcacannttgctatcatctanatctctntctcntcntcaccanancctntacaanntcttctccctctcncatctcncttcactctnncnacnntnacnncttaccgcacgcctccnctctcaccttcactnccccactnttcantntcgncncgnctctnngacctctcttcncncnattccannnntctcctcctaccnatnntcnattctcnntcatnactactntntcanctaccanancctnctcntcataantcccctcgacnntnncncacctctactntgcgcccncnnnccactttcctctcccnntangtcacctaccaancanntnnatctnntattctantcnantacnttacct

SEQ ID NO: 4137 - DNA, 784 bp, Homo sapiens
  misc_feature (1)...(784): n = A,T,C or G
nnnttttnnttnttggngnngnnnagtngggggtttnctttttttntaanngctgcgctacttgttctttttgcaggcatcccatncgattcgaattcggcacgaggagatccaagtggtttagaaggggatgattgctggtgaaggttctgaacatggtgacaggtgggaggctgagcacacactcgtacaccgctggcaggaagagaaatgacttttctggactacaatttggagataacacaaacattaaaaagaagaaaaaattgtatccctttttgactaagcaattctaggattgttatttttttctcctgaggaaactagcatggatgttcacattcaggtgtggggatgtttatcaatttgctattttagaaaagagaaaaaaagtttagcatgtcacaagataattttcatcaatatatggtacatccatttagtgaaatgctgtacagccatttaaaaagatacagaagaggccaggcacggtggccttacttggctaattaaaaaaaaaaaatctgtagagatggggtatcaccacgttgcccaggcttgtctcgaacgcctgggctcaagtgatcctcccacctcagcctaccaaaggcctctagaactatagtgagtcgtattacgtagatccagacatgataagatacattgatgagtttggacaaaccacaactagaatgcagtgaaaaaaatgctttatttgtgaaatttgtgatgctatttgctttattttgtaaccattttaagctgnaatcaaacaagtttncnn

SEQ ID NO: 4138 - DNA, 784 bp, Homo sapiens
  misc_feature (1)...(784): n = A,T,C or G
ctntntnggtcctnnnngntggctttctaatgcntaannctgntggtctngttnttttcgcaggacccatcgattcgaattcggcacgaggtggtaccttggctttaggttttcattcgcacggaacaccttttggcatgcttaacttcctggtaacaccttcacctgcattggttttctttttcttttttctttcttttnttttntntgagttgttgnttgnttttagatccacagtacatgagaatccttttttgacaagccttggaaagctgacactgnctctttttcctncctctatacgaaggatgtatttaaatgaatgctggtcantgggacatttngtcaactatgggtattgggtgcttaactgnctaatattgccatgtgaatgttgtatacnattgtaaggcttatgtcactaaagatttttattctgattntttcataatcaaaggtcatatgatactgtatagacaagctttgtanngaagtntangancancnatttctgtacctgatcaagtttattgcancctttcttttccnattnctttcntttaagggttagtattancaaatggcaatgagtcnaaaagntancatgaagattttnnaangagagaacttaccggacacagattngtgannctttgactggggacacctattggatgtgattcttaaaaagcttttnattggagccatttngccaaaattttgnaaanctttcatagggggnattggaccnttattatccnatnaatnccccctcctatattnc

SEQ ID NO: 4139 - DNA, 778 bp, Homo sapiens
  misc_feature (1)...(778): n = A,T,C or G
tnngnnncnnnnntggggntttcaatntttcnaantgngtctngttctttnngcaggatcccatcgattcgcaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacngggagaaggagctgccacagtggttgngtgaggaccagcgtttccgcctgctgctgangatgctggagaagcggnagatggaccgagcggagcacaagggtgagcttcagacagacaagatgatganggcagctgccaaggatgtgcacaggctccgangccatagctgtnaggaacccncagangttcagtctttcangaaaagctncatggagcnaatccttctgcctgatgaagtgcatctcagcatcacttcagctgtcggggcatttgtngggagaaccagaccacctctgcggaangcagcanacccttttccagccatggatngagtttgaattcttctataaacngntcaccatcanaccacccaattcatttccattgctttgcctatagaggaaatttannnaatcanattnaatggtttcactttatttnaaaancnnnnaactctaaaaactntggncct

SEQ ID NO: 4140 - DNA, 762 bp, Homo sapiens
  misc_feature (1)...(762): n = A,T,C or G
tggttntcttgntggggtgttccttnttncaattatgtgttctcgatcntgtngcaggagnannccngcgntggccggtgtgttgcccagactggncttcacctcctgggctcaagtgntnctcctccctcagcctccccaagtgctgggattatagatgtgagcccctgcaccagacaattatatttattnttaaaaacgcccctcatgaagtctgggtaattctctccagatttctccttatcaacaaatttataagagttaggaaaaaaatgatgtaaataaagcacttaaattgcgacagtggntctattcttaacatnataatgcttatgactaaggagcattcttntnnttataaannaaatgtntnctgnactgttagantacatgagggtcagagacnttatnagtntgtaagaatgcnttgtggattntnctaannnatcacctacagtaatgggctatggctaacaccctttnacaaaatngaggnncacanatgaaattccagttanagatcataanggtgtctgcggtgacccntagtnattncctnncgattacnggcgcnaaatttaacgatganctnncagctcannagntttggannatttnngctnaaatgctctcctggacactaccatacttagcatatncctgggaaatactaaccgaataatatncctttaaaacaccccggcctcaacagataagatctatgatctaacgtttnattcttttcacacattattattaatn

SEQ ID NO: 4141 - DNA, 860 bp, Homo sapiens
  misc_feature (1)...(860): n = A,T,C or G
tgggttnnnggnttggggttttcaantttngctaanagctgggctactngttctttncgcaggancccatcgattcgcttttctttgcagtatgaaggtagataattcttcaagttaaagatggacttttttcaccagaaatggctttatggaatcaatttgcaaaaatgtaagaggtggcaaaggaaagaataaaataatattttcattttcttctgttattcttagatcctttggtagattgtaaactccatgaaagcaggataccttcttttgccctaaggcttggcccaaaagagataccaaaaaaatacttgcttatatactaacctagtctctgggtgtgggagccatagagggttcanggtggggtggtggggaaggtggnggnnttncgtatatccgaaatgttncctcatnnaangnatttnnagcaagtttangaanganttttgctnaatgaaatngncanagaaccatnaanttncatanatgccnatgcctnaaagcngccttttgaagctttatcttaangntctcacccttcataacnncctaacgnatnacntntttccttanctttggnattnnatannnaacatangctcnncgtttattcaanantccanaacctnggnnggcnnttatanttnctcctntnccnnaacctttggaaanttnaancctggnncnttttnccatttctcctcttttttancanatanatannncnntcnntcttcntntananntnnnctcnnnncnnctnccntncnntcncttttnntnnncannntnctcntcntannnntttncntnnacannctnnctantnnnntnngnntnctccntttntntnc

SEQ ID NO: 4142 - DNA, 762 bp, Homo sapiens
  misc_feature (1)...(762): n = A,T,C or G
nagngcnnttnnggtgggggtttcnaattcncnctaaaactggggctactcntnctntccgcancaancnngcngntcgaattcggcacgagaagggagaggcagtaggactaggagttaaattgtcatgccgaggtctctgagcatgggtgggcctgtcagaattgtcatcgctcactctgttgacttccagcagctgacaggcaaggccctaggaagctcttcagcctcctttccttgctagaggtgctgttttccctggaaatgttcaagccctgcaaatcgtttctatagtaacaggtctctgtcttttttcttatgatgcagatttttgaaaaggtttcttatctaaatgttcttgggatctatggtcttcctacctgtagctcctttgattagacagagcctttatttaaagacttttccccccaagaatgttgntgttgcttctaccaaaataataaccantngntagttttactagtgcttgaagttntagtttattaataaagcttcatntnaactatnaaaaggantggttgngtacnaatagtaataccngaaaaaactaatattcactgntnctctcatgtattngnnaactttaattnttnattatgnaaaaccttcaaacataanagtagtcaaaattatataatagacacctatatacttaccacctanattgaaaactaacattcttgccatattggcntacnctattccatactgatagtaaancntagaccatgtatttacann

SEQ ID NO: 4143 - DNA, 783 bp, Homo sapiens
  misc_feature (1)...(783): n = A,T,C or G
attntacagctcttgttctttttgcaggatcccatcgattcgaaaaggtggccatgtgagaaggactcagcaagactttgctggctttgaagatggaagaatgtggccaaaagcctagggatgaatatggcttctagaatctataataaacaaggaaacattatttcccagagcctctagaaggactgcgttttgcttttgcctcggttttagcccagtaagacccattttagacttctgatctttggaattgtaggttaatgcatttatattattttaagccactaatttctggtaatttgttacagcagccgtaggaaattaacatgtaggaaaataaacgtttcaatgcccaggtatactctgaggtcaagccagagaagagttgggcagagacttcaaaaacgatgaaggaggggttaggaaggtcctagcatcagtggaatagaataaaattactcttattaagaggggaacctnaccnttagngganaaatnctgnaaatgggtctgagacaaaatgcnttanagcactggttgctagaaaaatcaaacataggagatttaggaanatggangcttgcaatgaattatgattgcatcactatatttcanccctcatccctgtcttccagaaaaaaaaaaaatnggggatttnaaaggtttattggtncttaanggccagcccntttgaaaaanccattggtttttggnaaaggaaaaagggccaatttaaaangggacctgtnttngtaccaggctttgttgnatttgggaaaaaaa

SEQ ID NO: 4144 - DNA, 1063 bp, Homo sapiens
  misc_feature (1)...(1063): n = A,T,C or G
nccccntnnnnaagggggggtggggggtctcaactngctagcggtgtgnacnncnaactngccnaaaagaaggntggggcnatccngcacgagntgacggngcgggntcgggntttgntgnttggnanaanccttccnatatctccagtgcggganncactatctggtatctctattgacctacgggangctttcctnagtcantcgctacnccactgnactangnganaccacgcnacnntacncttanatncntcnngcacatctgaantcacnnggangnttagtncgcagcgnccgnntccacannccnngatcacgcgccctcntnncnaanancatannctcacttgntgttncnccgnntannttangttngnccnnaacaaancttacnncnttntcagnannactccacctcttccnccgaaactnnncnnacngnncatnnnanccngcttcnngcnnctncnnnnnngcngnnccanntnntnaatngccntcnnctcaacacgcccaaaccttacntatatncctttnaccacncttnncnnanccctctaccncccganctctcgttncccccatntcnanttctnctctcncnacncncccntctcnccnncctcattccccccntnaatngnncctncatcncacnacnttgnatgacntcttctcnnccntaccnaccncntctccaactncntctggcaaaannntcctcncnttcatatactantnnntatctnccctntgnacnntcttncngncgcaaaantcanctcctacacnnnacacntnncnctcncgctngcacctatctactcaactnctatgcactcatcgnnnncaanatctnacctcncaaactctntncnactnccncananccccccacnnanacanangcgncaanacaccnncacananggcgatacncttatnacnctcngancnnanatcnccnctctacncncnancatncacgtntctcnctatcatcngcgntcncncaactcagcagttnannacnccatactnnctncangggctcaantat

SEQ ID NO: 4145 - DNA, 996 bp, Homo sapiens
  misc_feature (1)...(996): n = A,T,C or G
gcnctttgnaannttttcctaatgctggttttgctacggaaacccttggcaaatccggcacgagcttcctgtgccaggggaccgtggagaaagtgtcaggggccgctcactgcagcanttttgctctgctgcctncccnggcagcgtnctgngggtngtacaccaaaanagctgggtgtncgnggcgggtgcttgnaatcccanatactgnangangctgaagctgcattatcgcttnaaccnggggggnacgangangccanggagncaaaatgggggctnttagancaaaactttgtntcanaaaaanaatgaataatnanacaagaaaatggganaagccccaataacttacnnngtntctcntggccnaangcaaaaactccacttgnaaagccanganaaaacggggnaanancaaaacaaanctatcacntggaccnnnaaacanaaanccaaaggattnncnttccccnaaattggantnaagattcaatggacatggnacnnaaaaatncagnggtaccggaactccnganangcnntacaggttgcncaaaaangaaaccnnaaaanncggggagngnttnattaaaggggggnatttncgcncantttaaagggaaagggccacccaagnattnagncacaacacnntgttgacgggaantccattntnngcgaganaaanggntgntacatccccaattntanaaaanggcctnnaaaaaaanatntttnnaaccncacnaaatcntttancactaggggatttcnaaaaantagccnnnnnnaatatngggggaaaanaaaancgatnnnaganatcatacncngaaaaaccnnggggtnattnganaancaccntttnnaagntannggggcatngcancncaaagggngcantaaananatagncnganagnacattanaaccccttggtganaaaaaccccaagnangnccccaaanaggattggctnnaaaaaaaaaang

SEQ ID NO: 4146 - DNA, 783 bp, Homo sapiens
  misc_feature (1)...(783): n = A,T,C or G
ttnaagctnagctacttgttctttttgcaggatcccatcgattcgaattcggcacgagctaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatttantttattaacttggnttttttaattnacccttccttttgaggttaantttcatcacattatgttcaaanattcccatatnttccgtaaaattaccagcttaattacangggcatttgttcccattgggttanttnaaaaatcaggangtttatttaaaaaatncctgagttctttaagggcttggctttaaccttttcaantttccacctggnccttgtanaaaaccagttcaagcttggaaaaccaaagttctttnatttggngggtcantttcttgncaacttttttggactttganncccttggacannactt

SEQ ID NO: 4147 - DNA, 825 bp, Homo sapiens
  misc_feature (1)...(825): n = A,T,C or G
ggntnttnaaacnnnagctctngttctttttgcaggatcccatcgattcgcccggaagcatccaggatgtgggaacattgtgacatttgcacaatttttatttattgctgtggaaggcttcctctttgaagctgatttgggaaggaagccaccagctatcccaataagggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggcttttggtttataaatcacnccctttccaattttccgggtttcgcntnnttgggnttncggaattttnttnacccatgccanttcttattcaaataaagtcctgaagttattttgnaaattccccgntcattcggggaaatggaccccttgccccaatcaatngtggggnttcttaacccttccttnattggaaaccattnattcnacctcaaaacccccttttnaaccncttgnggccaacttggcttgggcaccttggtttgggctttcaattggggaacctttaatggttccaccnnaaggtgttgggaacaaccctaggggaccccccaaaaaagtggagccctcanaanggacanccatnaat

SEQ ID NO: 4148 - DNA, 792 bp, Homo sapiens
  misc_feature (1)...(792): n = A,T,C or G
tttnaaancgttagctctngttctttttgcaggatcccatcgattcgaattcggcacgagacaccctggactcctgcaggggaggacacacggaggtggacaactgcagatacacttactcggagtggcacagttttactcagccccgtcttggtgaagtgagttttcctaagtggcctacaaatctattttaattttctttaaactttataaataactaactggattctgactataattttcaattaattatgaatctactaattctactaattgaaagctattatttttcctcaattttaatttagttatgttcagatttaagtggttatttacttcccctcctatttttttaattgaaagaattactaaataatgtgtgatgagatttaaattactgtctcatggctttgtgctaatatttcccatctgacaacttgtaccttagaaaccaaaaatgtggtaccagcaanacccagcattgtncttttacttttgntnnntntngggaaanaaacttgacccccatttttaatttggccttcaantttaaatggggttgcnatgntnactttttcagcttaaaantttttgaaaaggnaaaagtantggactttttttanaaatggaacaccctgttattacttgctggccacatgccgtggactttttannaaacatgcttntactggaaatttatantggtgaatggtttgaaaccggacccantcttgtgcattttttatggttttgggaatnccntttganggncacacttttgttaaaaatnaa

SEQ ID NO: 4149 - DNA, 802 bp, Homo sapiens
  misc_feature (1)...(802): n = A,T,C or G
tnnntttcaaatncnaggctactngttctttttgcaggatcccatcgattcgaattcggcacgagngnagctcancnnatgtatnttgncacttgggagcatcatctttncaagggccactttgaggtgaaatggntnttttacatactnagcatcaatttggncctaaaatcaggagacattcacccttctccaccccaatttccaacatcccctcctttgnagagagagcactntngaanccactgagcccnatagccctagggcctanaccactattncaaaanggaagacttttcnatnactatgacanacacccannctggantcctctgcctgnactnaaagctctaaccccaacctntttttccagtgcaaacccttntactcactaaaaatttctntccactcaaactagcctggatgcccttccctgaacggggcttgtgtnttcccattagctcaactttgcttacatgcccaggtnnaaaaccccntttcnncaggccagacaaantgcntnanttntttcnnacacgtaaaatgaaaggctcttgnngtncntnaaaaggcctcttanaaactattgnggagtcntttttnccgtttgaatccanacttggattangattccattggatgaaattttggnacaaaaccncnaacttnnnaatgccnntngaaaaaaaaatggcttttatttggggaaaatttggggaangcttnntggctttaatttngnaaccttttttaagctgcnattnaacaanttaaccaancaccantggcattctnttttgnn

SEQ ID NO: 4150 - DNA, 788 bp, Homo sapiens
  misc_feature (1)...(788): n = A,T,C or G
ttnnttcaaatcgctaggctactcgttctttttgcaggatcccatcgattcggaacctttgaatagtggttgtacatacagtttttcagagctggtgtttaataacaatatttttcattctaatattacattattctttttatcatttaggtctttatccgtcagtgtttttagagaactactgcacttgaccacaaactgataaatacttggtactgccccatctcactgttctgtttactttgtcttaaatatctcttttttttttcccaggcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtccgcatctccaatcaggcatgtcttaactttnagtgcattttttatttancccttttaaaggnttttcaaattttannatgaaaagtttgnaaaatttnaaaatcagngggtttgaactcanaacatttttcataaaatgtttaattcactcaactngnctnggcttaaaaaaataggctggatggngttattangaaaagataaagtggtttcatggtaatctcaatggggggctaccataatttattttaaagagaaanggncngatttttttaaaaaccttgganaangtttataacttaaattntttnatnggaacttgaaaaccctaaan

SEQ ID NO: 4151 - DNA, 746 bp, Homo sapiens
  misc_feature (1)...(746): n = A,T,C or G
tggnnccnnaagccctttgcnacttnntctttttgcaggatcccatcgattcgaattcggcacgaggagttcaactgcaacatccgggcaccttcaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcantgcattgaggctncaagacatnanccccaaccngactncccaaaaaattntgntcanggcccgcttcttttggaaagggtttcctggacagatttccacccgaaaagcttcntgcacattgtgtcaaggacctgcgtgtgctcaatgctgttcgggactntcacattngggatcccgttacctattgccaatntaacaggttaccttcaagtgctgctggaaagctctgttgcggaaatttacccctggcatccaatttccaatnctgcncttctaatcaggcttacnggactggccct

SEQ ID NO: 4152 - DNA, 742 bp, Homo sapiens
  misc_feature (1)...(742): n = A,T,C or G
gnnntttnannatacagctcttgttctttttgcaggatcccatcgattcgaattcggcacgaggcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacanggtaaagnattanttgccaaaaaggtgtggaaagcntcattgacatgttcatganaatgctatgctacagactgaaaataataacctgcgtgtaaaattaaagcctgcaaganacngttgatgcattgaggtccagaattacacacttgttagtgatcaggccaccatgttcttgccaaacaggtgaaggaatgaggagattagtaattgatcatagtttttaaagaatcgaaatctaggcaaatttngaagtgaaccngatta

SEQ ID NO: 4153 - DNA, 742 bp, Homo sapiens; identical to SEQ ID NO: 4152
  misc_feature (1)...(742): n = A,T,C or G

SEQ ID NO: 4154 - DNA, 754 bp, Homo sapiens
  misc_feature (1)...(754): n = A,T,C or G
gnnntttnagntacagctcttgttctttttgcaggatcccatcgattcgaattcggcacgaggcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtnccaaacaggttaaagaattanttnccnaaaaggggtttggaaagcttcattgacatgttcatganaatgctatgctacagactgaaaataatacctgcgtgtaagaattaaagccatgcaaganacggttgatgcattgaggtccagaattncacacttgttagtgatcaggccaccatgttcttgccanacangtgaaggaaatgaggagattagtaatatgatcatagtnttttaaagaaatcgaagatctcanggcaaatttttagaagtgaaccatgatga

SEQ ID NO: 4155 - DNA, 773 bp, Homo sapiens
  misc_feature (1)...(773): n = A,T,C or G
gnnnnnntttnngagggggntttggggggttttcnaatttttctancgngtgagganctcgaactnnccnaaanaaanangcgggtcgaattcggcacgagatttgatttaaaaaaggagaaatgttcacactcagtctagaccacttaggtatgcagagttgcatcctgaaagcaattgctcacactttccttaatatactccctntccacctttgcaaaaccttgattggcatggagcctcnactgcttgcattgtatacacatgtaataagaaagcattaaatctcttggaaattaggaattgacaagataaatagataaggcataaagccaatttttcacacatgtccttaggctcttgtaaatgtgtgcctggtgctgctttgacttnccaggtccgggaggctttctctttctctcttntcccaangtgaggctggcaagctatcagnctctccagagcaaagagaaatggcaggagaattgactgcgtgaaccccacagggccggtagtggaaaaataaatgtctaaattgaaagggtcacactngtgtanatggtgactgtcntgcttgcancagctgaggacaccgactgngtgtagcgagtgtcctgcttttcatgttcacatctggctnaataaagaantcacgaagcanacctngccttggctnaaaccctntgngctggacacaaatgactttgattncaaactcaagtccttggnantgtcacaaaggacnaacccctggctgggacaaaancctacna

SEQ ID NO: 4156 - DNA, 773 bp, Homo sapiens
  misc_feature (1)...(773): n = A,T,C or G
gnnnntttnnnnnntttnnnnnnngttnttgaccanaggtaanacnnngggaattnctctttctgcaggatcccntcgattcgaattcggcacgaggcagaaacaatagtcaggagtttgagattnggctgattaacatggtgaaaccccgtctctactaaaaatacaaaaattagctgggtgtggtggcgggtgcttgtaatcccagttactcaggaggctgaggctgcattatcgctttaacctggggggcggaggttgcagtgagccaagatgggggcaataagagcaaaactttgtctcaaaaaaaaataaataaataaaaaataaaatatgtcaagccccttctcttcctgtctcctctcgtggtgtgtacttgactccccttctcgccagatctcacaggactttcagatttaagcaatacctggccaagaaacaaaagcaaaatcattccattcccccagtggattcagatcaaaactggtaataaaatcaggtcgactccaaaaggagacattggagaagaacgaagcggggtctataaggaattgcacgtgagatggcacacatatttatgctgtgtgagcattacaatcgcgttaccatatcaagctgaaaatgtcaccactatctggagtgttggaaatgtttattgggaatatgtnttttctctgaatctgctatgaacacgtnaattgggtgggttcaataataaatatgtgagacttttcatttcaaaataaaaaaggcaaatgatgtaaaaaaaaaat

SEQ ID NO: 4157 - DNA, 809 bp, Homo sapiens
  misc_feature (1)...(809): n = A,T,C or G
cnaanttttctaatgctgnttctatncngnatnctnggctanccnacnacnnnggatncnaattggcacgaggcttcatgagagactgacngctatnacgggtcgtggcacttaangaggactnttctggccccagngtgtgctgatgacacatacacacctgacaatagctngngtntnctctgnncctttnnctctgtnaccancatncacnngatctaaaaccctttctnaatatctatcntggntcatccttggccatgcagngtcagagctntatgnacttnattacncttnnccttngaacttntnntnagntacngataangngctatctttcagctggatgatnaacgntttnntctgtacgnacatggacgatgntttcctcaaacctctanaactatagaccagtcactgntacntntanccagacatgattnnatacatcnatgagtnagnacaaaccacaactanaatgctgtgaaaaaaatgctgnatntgatnaaatatgaaatgctatcgctatattncttccnncatangcngcngtnntcatttagcaacaacaattgcatccattaaaatntttttaaggnacantttgganngtcccccaatnttggngaaatncnanggccccaaaatgccangtgccnttananaccccggggaccccaaccttttngaaaagcgttncacaanaaggggtnaaagttnnanncgccttggccnnnaaaanaaacngggnaataacctnggttaaccctgnnntttnaaactngggnntttncnnnttnaaaaaaaaa

SEQ ID NO: 4158 - DNA, 834 bp, Homo sapiens
  misc_feature (1)...(834): n = A,T,C or G
ctaanagtttcntaatgcttncttctaatancntaattactcaggnngctcnannnaacaggcgntgnggncnctcaccgactcctccctggtncacangcttntgnggggccaccaagcccctnctgngccccctcccatccatantgcatggcgnntggngcccccntggctccaagacagatcangcccnancttgcntctaccnnnatnccnnctganaacgtgccactgaatnaantntgggaaaccagaaaagatatacattaatttaagaatcatttactatttaaatgagacaatcaatattattnnagaancannnatcccaaatgagacaatcatnnttaanttncaagatancagaagtgaccaatgtcatttnacaacacctanaagatnnactggtnnntcaggtaaangtaganttttactganaancctgnatgnatttgacttgtgcttttgtancnntnntntnccttacttntttngntttccatancctantaannatgcattactttnactggatataagnnnnatccttnaaaagggtctttctnttagctntacaggtnnacaatnatnnctggnctcttgacncatttgnnacttanntnccttanngcttttnagtataantttcnaaancnnggccntttagcttttncntnaggncanttnacccccttnttaaaaaaangnntanttncngccnnaaatttggncntgaatctttctccannntcggcttttccantatttttataaagccntgganagggncncaaantggntttggncttaanttccntatatacttanctcncg

SEQ ID NO: 4159 - DNA, 814 bp, Homo sapiens
  misc_feature (1)...(814): n = A,T,C or G
nnncctttggaacctcacngaaanccttccttctaatnctggcacgcttgganatcgaactnnctcnaaananatnggtttgnggcctggggcccttctagcctgagctggtgacctgggcatctgcaccctaaccccagctgaccgagtcagatctttgtccagtgttctgaagatcaaatgccgtgcccttttgcaatataacaccagctgcttttagtccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccanaagaagtgccanaagagacagtagtctgcatacatcgctgcaggccacagagcacttgggttggaagagagaagatgaaagggacatccttggggctgtgcccgtgagttttgctggcataggtgacagggtgtgtctcttgacagtggtaaatcgggttttcagagtttggtcaccaaaaatccaaaatacccccaatgaaattggacgcagcaatcttgaaatcatctctaagctttgctttcactttgtgaacnagttgnccttctattgatcccaaaagaaagttttctaagttaaaaggaaattcctangtgaatcaaccccacnagggaaaaacccacttgccacaataaggaaggccgggttcccccttggtgccnggtttaangggccccntgtaanggnaaacacnaccggggnaccttttttttttntaat

SEQ ID NO: 4160 - DNA, 775 bp, Homo sapiens
  misc_feature (1)...(775): n = A,T,C or G
tnnnnttttgaaanntttcctaatgcantngngaaacttctnaaaccntggcaatngctctttctgcaggcagcccagcgatncgaattcggcacgaggttagagtaagtaaagatatngttaagaaaagtacttaaatccaagaaagagagtcaacaaatatttataccattctctcattaagtgacactggttccataaatttaaagacagcggttcacccatatctatggntntgcattccatggnttcagttaccacagtcagcctctgtctgaaaatattacatggaaaattccagaaataaacaattcataagttttaagttgcatgccgttctgagtagcttgatgaaatcttacaccatccccctccatccaggctagtacatgactcatcccctngtccagcatatccaacactgnctatgctacccgcccattagtcacttagtagccaactcggttatcagatcgactgtcatggnatcatagtgcttgngttcaggtaacctttatcttacttaatagtgaccccaaatgcaagaatgacataatggtataacnggnctattnnatcattaggnaatggnantagnctcttactgggcctaaattataaattaaatcnatcatgggcatatatttagaggaaaaaaccatgggggacgtaggggtnggnccnatnngggggtcaaaanatccactgggaagnctnaaaaacatanggnccngaggaaaaggaangagncccggaaaccttnaattntncttaa

SEQ ID NO: 4161 - DNA, 817 bp, Homo sapiens
  misc_feature (1)...(817): n = A,T,C or G
gtnnnctttctaatggcttggctactcgccttctaatnttctaatncttggcnactcgttctttctncangnaccnntcgttncgaattcggcacgagggaagggaggtttaaggaagagactgtggacagaggtgttagggaaggtgtcagagaaggttaaggagccaacatggatcatgggggtggtacagtgttgccagggctggggaggattggctgcagtgtggggtacccagccgctgccatgtggagagggacctgtcactcctgctgtgaactctcccttcttctgccctctgacctcctgctggtgcctcccattggctaaacacagttgatggccagtgcactggggagctgttcttggagcccacaggcatctgcttcttggcacagagcagacaatggattgagtccnggagggaagggaactagagaatacccaagtcccaaccccangcgtttgctgaatgtgtctaatcttccttttctacaaacccatctgacctctncccctcctctccacgccaagctaggtcccaattcttcctcaagctccactccttccaccctgtaatcttttntatcaccctnccctcctnaacaccttgggtccggctttacaagnttccnttcccgngacttagccctttccccnacctttgcccaancaaattttacttctttaaaaaaaggtggcttggaancctaaaagacattantccaanggttaaaggcctccctttttccttttatccccaaatcaaaaacccttttaaggctcttttttcattcaaaattttaaaaaccccnct

SEQ ID NO: 4162 - DNA, 871 bp, Homo sapiens
  misc_feature (1)...(871): n = A,T,C or G
ttttcccnaaannngcntnggctacncgtctttcaaaatnttcanatcccttggcaactcgccncnnnacgcacaagaantntgngttggcgttcttgaggagctnagccttcgctcctnaggatcacaggcttncatgttgaagctggcagtgctagaggctannncctatctgngtgacagcatttnanatntancaggaccgactttgangttnccaaatatntataggcannctgtaaatcatnacaccgtntgcnatanctctcttcannctctgtctnnctcttntaactgnagcaaaagttctttctcangcaacaacnttcntnntatcctnagnagncnatactgtgttcctnnncatgttcggcgaacgctattacgnctgactncacncacncacntgacatngacccntatnncaaacnngntanggaaaagctanatgtctgnangntgctnncngcttgangantgctaanagcncttnagancatccattanctttctnnangcttgangttttanggctnatannnctntggaanttangtattctgggnatgaccctncatngcttntnanactattnaatccagacctcgancnntanncctggaangtnccncanccnaannantatccttggggaacnggnggtactgnactntngatcaanccnaananntggnantganccanttggnaaattgaatccntaatcntcccctgggcaacnnannggnggcttgcttnaaananntggaaccnnannatgcccgtcaaancttccctaattancctnggtanactgcnactggcanntctnnatanggcnaattccanaagnnntgantnttattcaccc

SEQ ID NO: 4163 - DNA, 829 bp, Homo sapiens
  misc_feature (1)...(829): n = A,T,C or G
tttctaaatggcttgggnnncnnccttgaccaccgaaaacgnttggcaacttnctctttctgcangancccatcgattcgaattcggcacgagataatttttttagtttgtttttgagactnctctgtcacccaggctgagtacagtggcatgatcatggctcacagcagcctctcaacctccctgggctcaggtgatcctcccacctcagcctcctgagtagctggtaccacaggtgtgtacctggttaattttttggtgtttcttatagaggcaggatctccttatgttacccacaccggtctcaaacttctggactttaggaatcctcctgccccggcctctcaaagggctggacaggtgtgagccaccaggcctggccccaagcttgtacagcagcatctgccccattatacctctggcactcaggcagtgatgcctcttggccctctggcaaagggagcacacttccgttagttttgtatttgtatggacttttatacctatgacgtttctggttctgntaatcttgtttttccgactgattgaaactttcatctctggtatcaattggggngttttcttagaaaaaagcttgtggtgaaaggggggcaaaaaaaaagaaaccaangttctgaaagttcacctctttgaattgcaacccacccttggtanaaagaatgggaatcaatnggaatgccttggccnaatttttgnanccnntttttttggcaaagnaaaangggatccaaaaagtggaaaccgggaaaaaanccttggggnaaaccctttgggtngggaaanggggttgggtngnacccaattccna

SEQ ID NO: 4164 - DNA, 797 bp, Homo sapiens
  misc_feature (1)...(797): n = A,T,C or G
tcnccctttccaaaaagcnttgggnnncgnncnttctaactttccnaatacntgggcaactcgctctttctncangcagcnnntcgttggcgaattcggcacgagactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgntagtttttaccttggatacaatgcaatgcaggatttttttcctactatgtccatgaagccaaatcctcaatgtgatgacagaaattgcaggaagcagcaggaggaatataagaaaaaggtagcagcactgcctaaacaaagaaggtatacaaggaagaggaagagataatccatgaagataatgaaatggggtattgaanctgggatctgaggttcaagaagaaggactggaaaaaatttttcaaggcccagttccagactttaccttgaagggaattaccaaggggcattacacaaatttccaaaaaaagcangaagaatt

SEQ ID NO: 4165 - DNA, 765 bp, Homo sapiens
  misc_feature (1)...(765): n = A,T,C or G
tnnctttctaatgtttnnnaatgctggtaccctttcaaancncttngcgccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagattctaacatttctgggctctctgacccctgcgctagactgtggaaagggagtattattatagtatacaacactgctgttgccttattagttataacatgataggtgctgaattgtgattcacaatttaaaaacactgtaatccaaactttttttttaactgtagatcatgcatgtgattgtaaatgtaaatttgtacaatgttgttatggtagagaaacacacatgccttaaaatttaaaaagcagggcccaaagcttattaagtttaaattaagggtatgtttcaagtttgtattaatttgtaataactctgnttaagaaaaaatcaaaggaccatgatttatgaaactaaatgtgacataattttccagtgacttgntgatgtgaaatcagaccacggaccttcagtttgnacctattggctttggaatcaaccg

SEQ ID NO: 4166 - DNA, 776 bp, Homo sapiens
  misc_feature (1)...(776): n = A,T,C or G
ntctttctaattacttatntgtcatggaactcccactntctcnacnnancnaggcnntgncgaattcggcacgaggcaagagatttcacagacctgatngtttttnatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggntgggtcattcaattggacgtatgtntgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcanaaaggaacctttgattctaaatatggagagtatgaatgggtcccttaagcccccgggaaatggatacaagtagaagaaaaattccatttattaaagtctgacagaatgatattgnatttgctgaacaagcctatctttgaactntgggaaaaattattttttgacagnaatactcttttcaaaaatgggcatttgcttgatttccanaaacctttcncgttctgggaccgaattacccaaatgcccatggaatttcccactggggggtttaatgtnnaaaantcccaantaaaaagtttttttcg

SEQ ID NO: 4167 - DNA, 741 bp, Homo sapiens
  misc_feature (1)...(741): n = A,T,C or G
tnncttcaaactttcgctcttggctttttgcaggatcccatcgattcgaattcggcacgagagttttggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattggaaacttttattccagttaccaataacacattcctcatttcctccagagacctcaccagaaacacctttaatattcatatttctagcagccttctgttcataacaatatatgcatcctgttaagatgataggagatttctctgcacctctcctctttgtgagcctgcagggacattccctttaatgtccatatttctaccagcagtctcttcaaggcagtctaggtttttcctaacatacacctcaaaattcttgcagctttggccaagcacagtgcctnacatctgnaatcctaacacttttgagaggccacatggacaagatgcttgagctcaggagttcaagaccagcccgggcaacatatgaaaccctgcctttaaaaaaatcaat

SEQ ID NO: 4168 - DNA, 789 bp, Homo sapiens
  misc_feature (1)...(789): n = A,T,C or G
gnnnnntttnnnnnnntttttggaaanccttnnnnnnnnntttcnaatncttgggcnactcgttctttctncaggcagcccatcgatncgcctttattcattttcactgttatccagaattccattatatgaatatgccataattttaaagttcacgttactattgttaagtgtttctaaactggaaattactccagacaatactatgagcacacctgtctgtggcttttgatgagcatctgaatgcaggccaaacttggcctgccaaacagtttctgccgttgtttgtaccagttcacactccctgccaaacagtttctgcaatgtttgtaccggttcacactcccacggcagcacatgaaagctttatttgctccatatcctctcaaatttagaaataattacaaacttatgtaaaagttaaaagtactatacaaataattttatgcctgaaagttgccaagttcatgccatattacttctaaatatgttagtgtgtgttttctacaaacaaggagattctcctgtgtaccagacagcagtcatcaaagtcagagaaantaacatcagtacattgctgncatctaatgcttactcctactcaaagtttcactantttgcttccaaaagtgtccttttatggcagganggatcanaantaatgtataggccaagcacaangccctggaatctggaaatcccagcacttttngggaaaaccaaataggaaggttgccttggaactcctgacttaaggcganncanccaacttaaaccttcccaaagngg

SEQ ID NO: 4169 - DNA, 728 bp, Homo sapiens
  misc_feature (1)...(728): n = A,T,C or G
gcttggctcttgttctttttgcaggatcccatcgattcgaattcggcacgaggttttggtactaaaggccgagactgttgtggcgacggcgacctctacggcaacggcttaagctctcggaggagtggcagagtacgatctgaaggaggggcttctggttagcccaggttccatcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccctcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagcttaagaaggggatggggccggccaaggggtgcacancgggaaagggantggtggcttacaatactgggactctgagtactaatatgctcagtcttattctaaaaaaaa

SEQ ID NO: 4170 - DNA, 735 bp, Homo sapiens
  misc_feature (1)...(735): n = A,T,C or G
tctaaacgcttggnncttgctctttctncangnanccnntgcgntncgaattcggcacgatctagatattgcccaatcgctgcccacagtgcacatacctttccaccagtcacatgtgagagggcagattttccaaatgctcatcaccacttggcactgtgtggactataattttggccagttaggaaatggcatctcattgttttcatcttaatttgcgtcagcctgattactcattgaaacttgtgaggttgagaaacttttcttaagcttattggccattcaagtttcctcctttatgaaatggttgttcatgtcatttgctcatttttatattagattgtttttcttttttccagctgacttgtaggaactctacatcttatcaatattaatcatttatcgaaaactatttgggtgccattatcttctcctagtcaatgttttttgtttgtgatatcttttataatatataagtttttaatgttggcagaagtaaagttaatctttttggctgtgttgtgtgtcttgtttgatgtaaagatagtttctgtaatagttttgcagtttgattgntcatctttaggtcttcaattcaacctgcacatccatcccctctatcctctttcttactctgtttttctccataccacttatcatccaataatatggtcatgccctttattnaccngntttgcatatataatttggcttgtncccggttccttccctana

SEQ ID NO: 4171 - DNA, 773 bp, Homo sapiens
  misc_feature (1)...(773): n = A,T,C or G
tanacnnattggtntgatgcntggtgctgcctgcgctgccttaagaagctgagactcacacaagtgttaagagggtatctctggagacanngtagagatagaccctgttacgaatcagagggccagcactaagttttggattaagcagaaacccatctnaatcgattccgacctgctctgtgcctgtgaccttgctgaagagaaaagccccagtcacgcaatatttaaactcacgtatctaagccaatcacgactatnaacacctctactttgaatcggacgctgctacccgtcaatgaaattgtgctcaaggttaactacatcctggaatcgcgagctagcactgcccgggctgactactttgctcaaaaacaaagaaaactgaacagacgtcgagcttcagcttccanaaggagaaagaaaatccgggcagcagttgacactggccttcagcctnaatctgttcccgtagcttnagaaccttgcctgccagggccaagtgccctagagcccaccccggtgtcctgaantcctngggggggaggccagccccctgggcttactgggcacanggcaagtggggctctcnggggaaaggtgtctgggngcccccttangaagggaancgctggggacatttgccattgggaccggaaagtcttggtttggcanttggctttngataanccatgctttgngggtcnagaccacccncctaaaggagccacgtggccngccaagccaccttaattgcctggcacctggcccnggng

SEQ ID NO: 4172 - DNA, 797 bp, Homo sapiens
  misc_feature (1)...(797): n = A,T,C or G
tnnnngtttcctantnnntgggctactcgttctttccgcangatcccntcgntncgaattcggcacgagaggcagtgactgccttcggctttttttctgctgactaagatctcctatagagagctacaacaatgcccaaaagaaaggctgcaggtcaaggtgatatgaggcaggagcccaaagagaagatctgccaggttgtctgctatgcttgtgcccagttacacccagaagtgaaagccctaaaaagaacatcaagttcaagggaaaatgaaagacaaaaaagtgatatgatggaagaaaacatagatacaagtgcccaagcagttgctgaaaccaagcaaggaagcagttgttgaaagaagactacaatgaaaatgctaaaaatggagaagccaaaattcagaggcaccagcttctgaaaaagaaattgtggaagtaaaagaagaaaaatattgaagatgccacagaaaagggaggagaaaagaaagaaccagtggcagccagaagtaaaaaatgaagaagaagatcagaaagaagatgaagaagatcaaaacgaagagaaaggggaactggaaaagaagacnaagatgaaaaangggaagaagatggaaaagangattaaaatggaaatgagaaaggagaagatgccaaagagaaagaagattggaaaaaaggtgaagacggaaaggaaatggagaagatggaaaagagaaaggngaaagatgaaaaagaggaanaagacngaaangaaacnggagatggaaagagaatgaagatggaaagagaaggagttt

SEQ ID NO: 4173 - DNA, 813 bp, Homo sapiens
  misc_feature (1)...(813): n = A,T,C or G
tntctctacnnanntcgngaacccttgntcccacgaccctcgtncgaattcgggcacgaggtgtgttctgtgggagggtgtctgtggtgatgtgactatcagggtgggcctgtgctggggatggggcaggcctgggtctggagaggattttgtgtgaaagtaaatggggtgtttgaggcgtatgggtggctgttggtgtggggaggcatcttgtgtatggctgttgggaacagcaaccaaaaggtgctttttggttttatttgagatcaagattgtgtttccgcttaattactagtttgtggtctatatcatagaagttatttcccaccccattttatcttgacaacccgtgtttgcatttctgtaaaacttctacaacttctggtgtcaagaactgtccagaagatggtactgttaactggtatttcctttgatgttttgattttgaaagtttactctcatgcaaatgtttcangcgtacatacataggcagaaagcaaatttttaggtgatttgtctgtntcttggatgaaatttaaagcaagctttaatggtctgacttgntcatttgaaatncaaaaaaagtaagtgaaatttaatggtttngcattaacctaaaggaaatcttgaagattnatggttgaaggaaattggtatgggccatgccctttggtggaaaccccngaaantcntttttaaagtttaaaaattgaaaaaaagggtttttaaatttgctttgnggccgtgttntaaaattgggaccccccatttttanaaatnattttttttcccgtcttcccttttaccaaacna

SEQ ID NO: 4174 - DNA, 786 bp, Homo sapiens
  misc_feature (1)...(786): n = A,T,C or G
gtnnnnnttttctaatagcttgggatactcgttctttccgcaggatcccatcgattcgaattcggcacgaggttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttanggagcatctcacacttgttagtatctggttgttgggccagcccgtgcctnctctagatctggagccaggccaggcaggggccacgtgtgggccagtcagccactacaagattttgctaagctttgggctgttggcagcatcttggacctcatgcctgggcctgaatgangctctttcttaagtggttttacaaagtttgggttttatttatggagtgacttaccccttccattcagagcagcccacccagccagcccttnaaccttntgggctcctgntgcttaaaggcaaaccgcctggttgggctccaccctgtgcattgggaacccaaccacccatgctnaccggnatttttcctcataaaagt

SEQ ID NO: 4175 - DNA, 785 bp, Homo sapiens
  misc_feature (1)...(785): n = A,T,C or G
tctaatgttngaaanccttgttctngaccatcccgggctnatgcttgggcacgagagatgttcttatccccaagagctgtataattccagacagaggaggcaggcagacacctctatagaggacttagaaacgactgttgtgagacacattcagtgctcaggatggcaagtgtagtataccgttagaaagaacattcctttggggtgtggcctaggaagttttccagatttttcactagcgtacatctaaggaaaaccgtaaacacagagctgccctttattcctcccacaggaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaaacaatgcccagaccatgcctggtgaagttgaacagcaccctggggacagcaacatacatggcacctgaagtcatcactcgtgcccaaagaaagggccatgggcgttncggccnacatctggagtctggggtgtgttggcntaganatggggactggccaaaagcncttggcatgantattgannccacctttcaaattatgtataaanncnggggatggnacctaaanccccccaatcccngnananaattaaacccctt

SEQ ID NO: 4176 - DNA, 848 bp, Homo sapiens
  misc_feature (1)...(848): n = A,T,C or G
cnnnncgnnnnnncnacnannnnnccggnnaacnttcnaggccnttnnaantcccnnttcnaangcttggcnatcgnctttcnncangnacncngcgtnncggttggagaaaccaagctgaccaaaacatggtccccaccttttggagcttacagtctgttctggggaacagagattcagccagnagtcaagaaacactggatgccagctagattatctgntctgtgctttggtgtctataagtacatatgtggatatgggttcattttatccctaaacttagtaccaaaccagcatttaatatctaattataaatctaatntggcctaaactttattattgcacactgcctgaacaaaacctatttgtctctatgtaaattntttcctcatggaacaagggtgtgaaatgaaaatattttaggatttattcaaaaacagactattctgttttcagcttcagaattgttctttgaatcctaaggaacctctgtcaacagtngaggcngctgttgaaaagaaagaaganngaggcngaaatctctcanggagaattatttcccnttctnttctatttcagatacctggaggggtggggagangtaagaattgtaggggaggatcannnctnggggaaanctgtgaccagctnaatgaangaatgatgattgaaanaaccctcttgcatctctnagntacccttcngcntcccttnnacccantggtataaaatntngggcntngggcaaccactgaccatttgncaangccttaattggnccccaaatatccnacactggtccnaganccttaaangtctccagcacccgacncnntnanaanncgnnc

SEQ ID NO: 4177 - DNA, 836 bp, Homo sapiens
  misc_feature (1)...(836): n = A,T,C or G
ttctaaananntttgggnnngtgnncttctaatttttcnnatacntggcnactcgnactntctnnangnagcnnntgngttngcgaattcggcacgtagctgagcacctcgtctctataaaaacaaaacaacaaaacataaacaacaacaacaaaaaactatgtgataggcattgtgttaggcactagaaaatagtgctcaaacaacaacaacaacaacaaaacatgattcttgtctcaaagaatgcacaatgttggggaaagacaactaaaaagtnataaaacataaagtttgaaggatattatgatagangaatnataggatacgttcaatcatttgaaattcntgaatgtcatccttttgggtggagcaccgagagggtttgtgaaaaacttcccacataaagnaatntaancnatgcattnnntaaaaatactnatgtntttnnaaaaatgaatatggcaaatgaactgtnctgcctancatntgatnaaggnntcacttttccatnccnanggnattagcttatnnnacttcanacatttcaaangtggaaaagactcancanattcaaagcaaccattcttgtaaagtttaatttccntgtgantcgttcanaattnnaatncttgggaaaaatgaacctgcaataagaanaaaaattggtttcactttttcaatnggggttaaaggtttctggacttcacccaaagtggctttttncaaatgggggggncccntaaaancaantatttaatganggaacttatntttgcggtttagcnctngggggnatncttttgncaaaaggtttaaaaagccaattnggnaangnt

SEQ ID NO: 4178 - DNA, 775 bp, Homo sapiens
  misc_feature (1)...(775): n = A,T,C or G
ctnnctttnnncctnaagtgaaatcgttcggtttancctttngcaggatcccatcgattcgaattcggcacgagcttagttccacaaataattattgatttgtttaagcgtgatgtatgtgcttgctcaaggaattagaagatgagtatgacaaagctcattccctcagggagttgagtgtttcagagggatgaagtaaaagaagattttaaaactacaagtagagtgtaagaagtatcacgagaaacatcaacaaagggctgaggatagaaggtgataagtctcaagtatctcaagatattcagcagtgaatcttaacataaatttgcttttaggggaagaatttcaagcatattgataggtcttaaattttctagtctctctgggatagtaggaaggagaatgatttttaaaaagttgattatgtagcatggagtttggggactagtaaaaattttattgaaattatttgggaattgttttacagttgtttttagtggaggttgtatttctgaaaatattgcattttagtgtgatgatttactaaagaagtagcagggacttattctaaggtaggagatagaaaaactaataagtaaaaatctgctagcaactttaaatggctgtcaaactttttttaatgattaagtgctaatggggggcagatggaaattgtaaagccagtgccanaacaattgaggtatagaagtttttttctgtcaattgctctacttttgaaagagaagaaaattnganggcaaaatttaagtcattt

SEQ ID NO: 4179 - DNA, 816 bp, Homo sapiens
  misc_feature (1)...(816): n = A,T,C or G
tnncngttncntattanntgggtaatngcttggntctngnnctttctncaagatnccatcgattcgcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttatttcatggatcccttaatttcatgggcatgcctaataatgatctatgttctaactggagcttanggcttattttagatattgggagtgtagcttttatttacnagatggattttatctttcaacatttgcattttgatcaacttttgtaatattcaccgtgtatttaaaaatattggtgcacttaaaatgttttncccctnngnttnctttttatattgggtccaaaggcantttantcaagcanctntttggnaatggaaactcaatgttaaanttggcnttgggttcaannggaaat

SEQ ID NO: 4180 - DNA, 746 bp, Homo sapiens
  misc_feature (1)...(746): n = A,T,C or G
tnnnctttctaatgcttggctactngtctttccgcaggatccctcgattcgaatccgncacgagggnggctgccgtntntggctttngctnnaagggcnangttcgggaaccgttccacancatcctgatgtcctgaagggactcactgngcccattgccagcagtcgncattccctaaggtgctgtgatccanaangcgggntgngaganattggggccctaccctactnactntnncccacaccatgtntaaaatactcannntntnnangggcnnaanacngctatctggaccccnatcaggnctgggnaacactgttnaaaagtcccctttcatgttggccccatgaanagaccacngaccacgnggtacntggagctcgatntcganagttctcaagngggaactgaggggacttccactnctntgggactnnggtcnactnncgtgnanancgggacnactacatnntggnctctttctgancaccaccctnttttcacgatggnacntgtagaagggaaatgctgganngatccatccntcntgntctcttcttcngccctaaatgnctgcanncanntccgnncngtncntnacctgnnnggtccttttggccccngcnttgncatgantaccngnntacctgcatcctancctgacacnntttgnctctatcgctgcagtganggaaangtgggtgggtatttttccccaataaagactttagacccctnttttnct

SEQ ID NO: 4181 - DNA, 865 bp, Homo sapiens
  misc_feature (1)...(865): n = A,T,C or G
cgtnncccttttcaaatgcccttggctactcgcctttacgcaggatcccatngatncgaattcggcacgagccaacctgctgtccctcaagccccgcttttaccagcctgtggagttcaggaggcgagacatnctggcctcctttgagaactgatgggatctaccccctgtccacgcnggacagtntctcagaactgggtcatagaccacctgtgttaccaacagccagatacctaatccctgagcctnctttgggaangtctggggccgagggtctgggaatntgctttntttttttgggacagagtctcattctgtcactgcactccagcctgggtaacagatcgagactcccatctcaaganaaaaaanaaggancagggcatggtgntagtgtgactggggtnccagctacttcanaagctgaggtgggaggatcccttgagccctgtaagcggaggctacagtgacctntgatgccantgaacttncgnctatgcaacagaacctgtcttaaaaaaaaaagtaattaanaattttaaaattcaaaagtgggactattnatnggttaacagaactgnntttaanaatgccntaaaaatggtggcnccattttttttaanaaccnttgctggntnttattggtnaaaaattgnantggntcttnccntggccnnngtcnntnaaaaattntttngnangggcnagnttttatngtnaattgnctcgnaaatntgnnnaanatttcattcccanannaangntnnnnttcccttaaaanntngnactnaattgccnttactgttncccntnaantttaaacnacnnatttnttntaaaaccttttnaaangnaacccnnnccc

SEQ ID NO: 4182 - DNA, 989 bp, Homo sapiens
  misc_feature (1)...(989): n = A,T,C or G
tncccttgttgaaanccctttgctcctttntnctnccgtttgncatncnattcgctcagctgaggcaattaaactggaaaagaaatagattgaaaagatactntngaagaagcagtacagaagttgggggactgaaggagagggagccactgcaggtgctagctgcttaaggggataccagtccttttacagatataatagatacagcttctgaggtggagggtgataggagtgtgtatgagaaanttgcagnttnacaactgctcntgcctcctnggcaanaggannancntttcnccnnttncnncccttatngnacacacattgncctgattggncntnccncngctagcttncagtcttnantntactcannagnnnntnggggaacncnctntcnnantatgntcccttttcctctnncntnnccnnatancaccccnctcnctttcctttctaaacttncacanntccctganaatgncttccgaatggantcttngaatttctncgcccctncntcntcataatcnttttgctnctccngctcnccctcattttnctacgtnccnccttctnnttnactgnctttaaatnttattancnncntntncnttncnatctncaanttttcnnnccnacnnnnttttnctnntnncaaatcgcgnnaaataagtnttgcncactcnnntnctancntattntccctcgcnnttntcntcatctcccgcnncactcacntnnncnnntcaattnntnnnnacncncnctgctctacnnncnatntctntncctncacaccctntancntntcnctcanaatgccttttctnccttannnctntcnttcncnnatctanccaantttnctttnacatcccctncnnntctnncccgacnatatntnacctcttnnatcncagngcntannatcnccccnttntcnctntcnctctcanncttntnttnatcttcatnnatcanncncc

SEQ ID NO: 4183 - DNA, 820 bp, Homo sapiens
  misc_feature (1)...(820): n = A,T,C or G
tnncctttctaatggcttggctacnggcttctnaagnatccctngtttcgcagctatagcactaggcagccttgcatcctgggtgttgaaagtgcaggccattatcctcccctctgacctccaagatgttaggtggcctttctgtgcctcagttttatcatctgtaaattgggtatgattgtactagtgcctagtacataaggagtgctgcaaagattacatgagtgtctttaaagtccttacaacagtatctcacacatagtaagcatggcatgtggtagttactatcatttagtccctcttggagcaatggatattaaaattttaaagacagttgtctgntnaggattggncatgcagcctgaagtttnaaaacaaattgcacctgnctgtgtncatgggganactttttaangccctggacctnattagctnaatgggctgtggaantgnatggggccttttgnagggcnccnnttttnnaaaccccnaaattttanaaagnttaaccccaganncttnattctncattttaactggcctnttggnagatatatnggcagaagtttttanaagggtnnaaaagttttttttgcnccnanaaaaanggggcttaaacttttttaattcnngggtgnggcgccnnaatttttcaataaaaanntttcangaattattaannggggtnggatnaanngantttnttnttnanaaaggatttttaaanaatttggggggaagaacccnaattattaacngctaanttatttnatggcttccgactttnnaangtttttngaaanannccnanntttattnn

SEQ ID NO: 4184 - DNA, 810 bp, Homo sapiens
  misc_feature (1)...(810): n = A,T,C or G
tnccctttnctaatgcttggnataccttggtttccaatgnttnccagggttncgtgcactccagcctacatgacagagtgagaccctgtctcaaaataataatantaatgnactgagactcagaaaagatgttngntcaaggttacaaanctcanacnggacagggcagcattggnaaccaaaatnggtctgactcctangctcatgctgnaaatnacngtgcaaggcttntactatctatntttttcctaanngaatgtctaaatgnacngatggttaacatattacgcagaatatgttaaacgtcaaatgaactgtntnaacnataaatgctggagagttgaagtggccaagaactcatgcccnaggtgatctgggaangcctcttgaacaaggtggaattatagctggtttttgaagaatccgaaaggtgcttagattgaaaggtgagacatgtacaggaatggtttctaagatgtcatattttatctctgtcctcatcttgactggcactaatgaacatcaaagatttnaacctaaatncattgagtgcccagnatgtgaagggccttatttatgtaggttttaaagctttttaacatactttaaaagaannggactggttaatctncactgncttagatccctttangaccccgggagcccggattggcccccagggngcccttttgggaaatgggcgttggtcngggaccaagtcttncacnttttgggaccntaccccanagaaaaaggaaatgggtccctttgggggaatttttgccaggaccttacaattcttgggaanaa

SEQ ID NO: 4185 - DNA, 820 bp, Homo sapiens
  misc_feature (1)...(820): n = A,T,C or G
gnnnncttttgaaancccttttaancccttgctcttgntctttttgcaggatcccatcgattcgaattcggcacgaggcagaggcagggctagaatgttggacttcagatctcttacttctgtgtgctagtgcaccattcttagtccagcacagacaattctcaaacagattagcaaaccaccctcttgaaattgcaagaattgttaccatgtgatcaaggcatcataattaatgcaaaccctagtttctagttgggaaagagattaagatggagactttgtagtaaaagatggacatatattttattcacatagcttatttattttgaatgaaagaccaagcaaactctanccttggcctgtcctgangaaggtgatctntgaaataaatgcnctgnanaatttggngacanngngnctnncctntgatntatctgntnttatccaanggttcnaatnntgtncctnttnatnccntattccctnnaatttttnttgnaacnnncccnnnatttcntnatngncccttttcttncntnacnccttntaccntttatttntnnaanncccnttttcnnnnncaatnctngntcntnaantcntnnncttntnnttnncttttannccccttnnccnttnccccctnnnnnttaanacntcctncttatttanntcntncctnttttcttctccnntttctttaactnntnnnncttccacttctttaccttatatacnttaanntctctntngtattntaaactcnttntatcttnccctntctnctaaatncatcctcanatnnttagnnnctcaacct

SEQ ID NO: 4186 - DNA, 847 bp, Homo sapiens
  misc_feature (1)...(847): n = A,T,C or G
nnnnntttncncccntttgcaaacccttgcttctnctttcnaattggcttggatcgattcggggaattctctgccttttggggaacagttacagaggacctnntaaacccttgtttngtgccaggccccgagaccacagagataacctgggacccaggctctgcccatggggagctcccagccctgtgaggaagacaggccatcctcacccagcacatcctactgtacccgaagagagggcgcagtgactcattttttgccgttggcattaggtttaaaagatggttgaacgtccacagaaggaaaaggaattcctggcanagggccctgcctgagcataggcagggaggctgagcagccacgtgtgcttgagcgctggtttgncgaggcagcaagcggcggctgtatggtgttgctgcagctgtatggtgaaagggtgttgaaagctganccaggaatcaaggctgctggccacagacgcattgatgatggatgacgtgctggtggggctgacacctgaaaaaaaanggtgtcaagttccaaaacaanggcctggcatacaagtanggnccacaagggagaagcatgagggaaatggcttngcccgcctggggntccctggganaantnancaattnntcngnatgnnnaaggnncnaatnnnnanaacnnnnnnccnnnncnntnnnnannnnnnnnncnaaannncnnnnnanncnnannntnnnntnaanattnnnnntntnnnnnnnnnnntnanaannncnnnaannnnncnctanctnnnnnnnannnnccnttnnctnnnnnanaanngnnnntnnnnnnnnnnnaannnaccccccnc

SEQ ID NO: 4187 - DNA, 884 bp, Homo sapiens
  misc_feature (1)...(884): n = A,T,C or G
cgcttggtttgagcnnctnaanccttcccatgcgatncgaattcggcacgagggacagtgggcctggcccgtggagctgccacgcaggtgcctgagggcnnngtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttgctgaaaacactgaggtgctcccatctgtgcgtggcccatgagctgggatggtcctncagcttgcccacaaggtccgnccctctgtctcttgcaccaacctgtttgcataaacacactttgctacaatcttgctagtgcgttttcttaaaagataatctatttactgtaaaaaataaattggactttgcaaaagcttttagaaggaaaagaaagaggattaaagagaattgctggtgaaaaaaaaaaattccataaaaaaaaaaaactgggaanccttttagaacttntagttgaggtccgtanttaccttaagntnccaagaccntggaattanggaattccaatttggattgaagtttttgggaccaaaaaccnacaancnttnggaaattgccaatttgaaaaanaaaaaatggccttttaaattttggnggnaaaaattttttgntggaaatgcctttatttgggccttttaaaatttggggtaaaccccaatttttttaaaagccttggcaaattaaaannccaaggttttaaacccaaccaaaccaanttgggcattttccattttttnaatgggttttccangggtttccaagggggggnaagggttttttgngaaaggnt

SEQ ID NO: 4188 - DNA, 781 bp, Homo sapiens
  misc_feature (1)...(781): n = A,T,C or G
tgtnnctttncnncctcnnccgaaatcnctttgnttctaactttcctaattacctgggctacttgcactatcccntcgatncgcatagatggccnngttactaanggtgantttccagcgcggggggcacgtggagtcactggaacatttgngcaatgctggtgggaatgtcaacccgngcnggcctctggaatangcctggcnnntcctgcnagagttaccntgtgacccagcaattccactcctagctccacccacaggantngaaagcnaagacgcanacagatgcctgngcnccaaanttcacggcagcatcctncgccatantggcancatccgtcgtnacagcggcatcatccttcatcattacggcancatccgtcgtaacagcggctacatcacttcgccacagnggcagcatctgtngtcacagnggcngcanccttngccaaagcggcagcntccttcgtcatagcggnancatnctttgccatancngcnaggtggaaaccctgnccatccactgaggcntncatanactanncatggncagtccagggcactggaanccangccgtngaacggcgccnacggtnannaggaatganaccntgatgcnctggggccanacatactggctanacanacttggagacatcatgcttanttgnannnccantcacacttgcnnncggcgtnatcctgctcacgtgatncgacccgaatgggcacttcaaatgggaanaagggngatggcactnccggtnncctnganaggggn

SEQ ID NO: 4189 - DNA, 851 bp, Homo sapiens
  misc_feature (1)...(851): n = A,T,C or G
tnnncttccnnnctcnacngaaancccttgtattgccctttatgcaggatccctcgattcgagcagctgcatctaggggcccttggtgagatttacactcantncctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggcttgggangagcccagaggccccatctgtttcttcttccaggagttgtcaaggcagcagaaaggagtcacccagccaaaggaggaagatggcttcaccgggctgcaccaaggggccaagaagcccttaccccgtgtctaaacccttctctcacttccccttaagccttggtgaaaagaagtcaagaaagccccaaggcttccttttttcttggtttcttnaacttcaaccagcttaaaaaaatgggctttccagggtanttggaagttcaattgaaantttcaanaccattggtttgggnggttaaaaggttttcttccttnttggttncctggaaaaaacctttcaatnctttcntttgggnggtcttcantggtccntcaaattctttcccccttntattgaacattgccaaaaaaaccnanccttttttttttgnaaa

SEQ ID NO: 4190 - DNA, 741 bp, Homo sapiens
  misc_feature (1)...(741): n = A,T,C or G
tnnnttctaatantttggatcttgtgtctttntgcaggatcccatcgattcgaattcggcacgagcccatgtcccgcccgctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaagaaagatccagattacctgaagctgtggttggacacttttgtttctagctatgaacaatttttagacgttgactttgaaaagctgcctaccagggtagatgatatgcctccaggaatatctctgcttcctgataatattctgcaggttctgaggatccacttctacagtgtgttcagaaaatggcagatgggttagangaacaacacaagccttgtcaattttgcttgcaagttcttcattattctttgcaggtatctagtagaaaaaataaccttgtt

SEQ ID NO: 4191 - DNA, 730 bp, Homo sapiens
  misc_feature (1)...(730): n = A,T,C or G
ttggnnctngttctttttgcaggatcccatcgattcgnaccgncnggccagctgncaggnnacaggggctgtaggcccagctcanaccacttnggagctntggctntnttcaaaaacattgtngactctcttacccacacattcctnngctggaaggggagattgacaaaccagcatcatctctangttactacaaaagccctcnctggnaattattcttaactnancagctggtagcgatccattcngaaaaagagtacnntagactgagttnctctgctgntnaaannnctgaanagcctnctaantntacctancgnaaaacctananncctttncatggcctgctangccctgcgccctntggcccatcntntacgaccacctntactactgccnttctgtnaggcctntgggcccaaacctgtncctatnaatccagatggcctgaattanctgaacaatgacanangatgnnaaaatggcctgatnctgccttagctgatgacattaccttgnaaaancncttctcctggctcatccnggctcaaaagctnnccanctgagcactgggacctaaacccctgtcnnccagaggaannacccnctatgactgtaattatccatacctaacccgatcctataanatggcccgcccnttctccnntcgctgancttttcggacnnancccgctgacccaagtgaaataaacagcnngttgntcacact

SEQ ID NO: 4192 - DNA, 730 bp, Homo sapiens; identical to SEQ ID NO: 4191
  misc_feature (1)...(730): n = A,T,C or G

SEQ ID NO: 4193 - DNA, 774 bp, Homo sapiens
  misc_feature (1)...(774): n = A,T,C or G
gtnncnntttctaatgccttggnnntnnccttctaatgcttggctcttgttctttntgcaggnatcccatcgattcgaattcggcacgagcctagttatgctataatcaagcaggaaatgtttatggaatggaaagattaaggaaaaggtatgttcttattttagcaataaaacgaataccagaagctttaacattcaccagtacaaataaatagtttcaatggaataggtcgaaagtaaagggacatcactagagtaaatgctagaccttccctctccttttatttttagcaacagcaaagcagaaactaagatctacaagtgatcaaagagggtgatccattcagtttctgtgtagacaggaataataataataccttttacatattggtacagtttgtaaaaacactttcacttactcatttaatcttcatagcaacttgatgaggtagaatactataggaagcagtattagctcaggttggtacgtaaattactgtgtttaaatttcaataaaacagctatggaatccaagacattcttggcgcctaataaactgtattctttgccaacagtgaaagtgcttctctgttgcttggtaagttttttccccttagaatactaataaagtaattgattaactttcatttttattttgatttgattgggacagcaattttagcagtaaaaaatgtcacctttataaatcctgtggtttctggtcttggncaagttaaattcaacctgaccaggaaggcacgctttaattcttat

SEQ ID NO: 4194 - DNA, 771 bp, Homo sapiens
  misc_feature (1)...(771): n = A,T,C or G
gnaacntttngnaaanccttngttctaanngctgggntcnnttggtntctgcacgatcccntcgntncgaattcggcacgaggtcagatgttcctggnttacgttgagctncantgaagtgagaggggcanagggggcttgggaagtcacaaggtcanggagaggagaagaagcgtgctggatgagtcacactgnaggactcaagccagtaggttcttggtagcccgnntactgacctggagccangcactgatagcaacgtgtnctctgagggaaggcnaatggnaaatccaagcangcactgggatctgcctgtgacactcttgtggggcctggaccctcnncctaagngagcttgggccantcagagccaccccaggngcccctnccttnatctccattgtggcangcacaggaacattgtgatacccanaaaatggactcctgtcttgtgcacaggatgcacctgngtttnctatcttncattcctgaganctntnnagccaggaggacctganttgaatcctgactttgccnatatnaatgactatgtggctgtnggtaacttacttatnctacatgagactacttgtttcatctgccggaaaangtaccatannatctgccttgccnttattgacttnaggataaatcaagtcngntantaaagggaaanntntgttncacttgaaaaatcaattaatggttcattgttcctccntttaaaanngaaatacaaangcttcngcctttagaacnntnntggagnnc

SEQ ID NO: 4195 - DNA, 744 bp, Homo sapiens
  misc_feature (1)...(744): n = A,T,C or G
ttccttcaatngntgggaactngttctttccgcaggatcccatngattcgaattcggcacgaggatgcatgaattactgcattaaaattgatttatgggaattattgttgtttcagtagcatttcaattcagttgccaaatagagcagtgggcaatgttaacggaaacaactgcaattggcgcagtatggagtgcctatcgcactaggaaatctgagggtcacaaaagaaaggagatgtgaggataagaaactttgtttttcccttgttgggaactctttaggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggtaagataaacagcataaagtcttacccttctgcagtaataactggaatatgttaataaggtcatgtgttangtagtatagcagagaaaccccaaatttgcagtatcttacctaatatacttttaattctcactcatgtaaagtcctagatggtgtcctggatgctcttccaagtgccagattcagagacccagtttccttccattttgnggctccattatcatcacttggctnccaagactgcaggggaagatcatggatttcttcatggganaangggaagaggatn

SEQ ID NO: 4196 - DNA, 763 bp, Homo sapiens
  misc_feature (1)...(763): n = A,T,C or G
tntnnttcctaatngntgggctacttgttctttctgcaggtatcccatgcgattcggttgccaaggattctattgccatgtgttgaggagtaggagcaaggagatagagcaggaccaatgttacaataagaacccactattaacccccaagaatctgtcttgtgagggagataaatagttatcatacatgcgataagtcccacaccagcacatgaaaagattagaagaacaagagaagggaagaaacctactgacctgtttcagggtgggatgcttcataaagaggataacagttaagccactaacagtaatgcctctaatcttgaatctgttacctactagttttgtgtccctgggcaggtaacttcatgtttccttgcatcagcttacctttaaaatgagaataatgataattatctaacagggtccttactgaggattctgtgagataatgcatggaaagagcttaagtccatgcccaggaaatactaagtgctcaaagtaaagcatttttttttccttttttattacctagtcccacaagagcaatttttttatatcaagattagctttaaattcagaaggaaagggaatacttgaatggctcattgccagtaaccttatattgatgccatgttttgactttgagacattttttggagtctttttnaatggnaatacaggtttctggtggaaaccacccttgttgtcaaaaagtttcnntgaccttgtgtgtgtgtggngggtggtacacatgtgtcct

SEQ ID NO: 4197 - DNA, 774 bp, Homo sapiens
  misc_feature (1)...(774): n = A,T,C or G
ntntttnnnnnnctnnttggaaacccttnaaggaaanacntggcccttcgcaactncaggancccatcgattcgaattcggcacgaggaggcaggcagggcntttgggtcccttgttcagctgttatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcatngantcactgatctcttgtgatggggccaatgagtcaattgaattcatgggccaaacaggtcccatcctcttcatgacagctgngagctccttactgtgggagagctgcagggagccaaggagggctgcctgacacacttgccgctctcgtgtgaatccaagaaactgcnttnctcaaaggggccctggtngtcaccttctnccacagccatttccacccatcgnntgtctagaatctctttcattagcacattccaacccctctgacactnggtttaaaaatgagctccctggctcantggggccttntagaatctggaaccagacggaggtggaagttaagaagataggacagaacaagcaggcccaaagngctatgggttcactgggganagaccattaattctncagatgcttttactcctgatggcttttacccattattcttttcngttttaagagacatgggctnactcttgnaaccaagctgggaatgct

SEQ ID NO: 4198 - DNA, 774 bp, Homo sapiens; identical to SEQ ID NO: 4197
  misc_feature (1)...(774): n = A,T,C or G

SEQ ID NO: 4199 - DNA, 1068 bp, Homo sapiens
  misc_feature (1)...(1068): n = A,T,C or G
tccctttnaactccttgaatcccttgaattncttatcccatcgattcgctgatctccagacccataagggagatgctgagtagacaactggggcttttttggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagnttggtggggatctgncnnnaaacacctgnnanctgtcagngggccancanaccctntagtntcacngannnnntncnnnangcaaaatggnctnttnaanatctcngnttatntacccntngnagtcangnnngactacntnanaacatnctnatatgnaaanntatttcgcngcactcngnctttaaccanntctgtnctttncnctgggtacatgntcgnnatntttnctnggaaaanattaattggctnttttntnnanctnngnngaactgtaaanttnnacccttcnacannnaanntttnctctcnggggctncttncaatnnacntaatanggncacagnnnannctnancanatnannaaacccttanntatannacncnnnnannaaananttannngnnntntacncccananctntctnctnaaaaatnggnnnccttcnttcnnnaaaancntcatnnntnantntatanannggcncatttnactctnnccctataanantcnntngnnntccccannaaatctggggnaacaanctttgnnntcaaannannnctctnctnnncnctcacanacgncanttnntncaanngnncacttacnnnaantntntctantatatctnncnngnntcnnnnatntnngncntnntctnaancntttttatttnnananannaacnttanancccctatnncttnntctanaagcancncnaacaanttntccnngncntcctnnncc

SEQ ID NO: 4200 - DNA, 755 bp, Homo sapiens
  misc_feature (1)...(755): n = A,T,C or G
tnnnnttnnnnnnctcttcaaatccttgttctgcctttctgcaggatccctcgattcgaattcggcacgaggctgtcgggcctcagcagagctgcctacncacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaactggggactccccaagaaggccatgaggaagccagaaattggaggtggtaggaagtggtactgatcaatgatggccagcaggactcatctcctgcctaactggacaggaagcctgcacccacttctgtcttnccctggaactgggcactggcgtacactggtatccctcctaaagaagtgactcacctgactgatcagcaagaagcctanatgcaggcctaccatggatggcttcctagttgcctggggaaaccctggaatggcatcaggagaaagcaccaggaatccagtccttcnct

SEQ ID NO: 4201 - DNA, 766 bp, Homo sapiens
  misc_feature (1)...(766): n = A,T,C or G
naataccagctacttgttctttttgcaggatcccatcgattcgaattcggcacgagaaggccttaggctttttttttgtagggtgagagtgggggagagatctcttgctctgttgcccaggctggtctccagctcctggcctccggcagtcctcccacctcagcctcccagagtactaggattatgggcatgagccaccacacctagccaggctttttatattgagttggttatatatgcttcatagccacactttataatattggagtatagtattaaattacagcttgttgtcaagtcagtgtttctgtaagacagtatatccaatattggttagagtaacacctatttggtgatacagatcaacagggtgtctctgattaatttagctcctacatagccagaagcaagttcattatgatttagaatattgtacatggttatgcaggaatcatcccaacctatctgtgtttataggtcagatgatgttcagtttatatctgctgatagtgtatatgcaggaaaacctataaaaccacttcagacttgttaaaacagtgagaaagccgtgattgaaatattaatacaacccgtgtggtataaatttcatttacantgggaatgtaaatgctgtcatttgaatcttgncaaagcctgctactaaaactcttaaaanccttgctaggggaataagtctttantnccaaaaacaatatananggggatgtgngtggataatacaaggacaaccatatgttggtggcnt

SEQ ID NO: 4202 - DNA, 791 bp, Homo sapiens
  misc_feature (1)...(791): n = A,T,C or G
ggnnnnnncngggaacattncncnanatgnactcnttgcaaacgccccnnaatgcaggatcccatcgattcgctgaaacggaaacctttcgcaaagcctgtgcaggcagaggattttacacacatccttgacgtggcactgtgtcttcaggggtgctgccctcttacagagagacagatctggaggccatggccgttttggtgagaaatgccagaaacagcttcagtttccacctactgcttcatatttataatcacagtaatctatttctcgnttngctatttctagagcaacaaattgtgtgatgcgaaattagtaccagaggaacaatgactccacttaacaaaaaaatagcaagggaactatgaaaaatggcacaactgcttaactttaatagttgaagtctttaggagacttcagtagttgaaatgacacagaaaaatcctcaaactaacatacctacatgaaactgagtttctcaaagtaacccacatttatggaaatagaagtttgnnttgcagaaacatcagcncattttgtaaggngtatgtgatatttaaanttgtgatgcttgngaataagggaatggggctntaggtctgaggaaaggggagcattcattcaaactgggagggggttttgcatttttaaggctgctataagggcacgaacttggnggagacttggaccngntttccgnatgnatnggggaccntctggtctaagccattgggggngncnggactttctccaanattctntccaaacntgnctctcttaatttctccgaa

SEQ ID NO: 4203 - DNA, 844 bp, Homo sapiens
  misc_feature (1)...(844): n = A,T,C or G
ggnnnnntgnnnntttcnaatnctngctactcgttctttttgcaggatcccatcgattcgaattcggcacgagattacaacaatatggatagtagggaggaggaaaacaagaggagaatgggatcaacagaaggcatatatggggagtgtctggatggctggaaaattccattttttgaccaagatgtggtaaacacggggagtaaagttataattttttctcttactgtgcttttaggttttgttgctttctgtctgtatgctgtgttccacaataataaaaatatttaaaaggcaaaaaaaagtaaaataatgaatataaaattacactgaaactacatattctcatagatagaattgtaattattagagtttttgctgaataaagtcaaatagactattatagtagttataaacgcaagttaaaattttagggccgggcaaagtggctcacgcctgtaatcccagcactttgggtggctgaggcgggtggatcacctgaggtcaangtgttcangaccagcctggccaacatggtgaaagcncntatctactagaaaatntaaaaaatttncctggtttttggnggnggggctcctttaatcccaaattactnnggggagggttttgggcaangaaaaaatttntttcaaactttgggnagcccccaggttttntanngggcccttnnaaatttttnccaattncccctttcaagcntnngggggaacaaataattaaaaacnccnctttttcaaanttngaaaaaaaaaaaaaaaanaaaaatttggnncctttttaaattttnggggggggggaattttnnngaaaaccccccaatnnt

SEQ ID NO: 4204 - DNA, 777 bp, Homo sapiens
  misc_feature (1)...(777): n = A,T,C or G
aaaacnacaggctactngttctttttgcagggatcccatcgattcgaattcggcacgaggaaagttgaaatcctagttcctggagtcctctgtgatggcaaattctgccttccttgtttcttctttttttctcctctgttttcccattttagtagttcaaatggtttttgtattattgaagacaggtatgtctcaaatccatggaactcacaaaaaaggctcattttctatcctcaaggagctttacatctaatggaaaacacacagtgaagtccagaaggactcactgtggactggtagcaccatgagggctttccatgaagaaggacttaagccagacttagcagggtgggcaggtgttgaaaggagctcatagattgttccaagttaggagagcatcataaaaagagatggaaatttacttgctacagttttagatttgctctgctcatagcagagagtccatttcagagcatatagggattgtcaggacttaaaacctgctgtatttcttacttaagcacccctctccccagaatgataagagcccanctttgggccttggaatgggagtagaatgtgggtatactgtctatcatatganaaaattgcntngaaccaacccccccncncccncaaatgcctgcatgtnaaactggngaacactgggtaatatanatggattattatcaatgtcaacttcctggactggngaatttggcctataggtttnccaaaatgtccccctgaaanaaaaggtttttgggggctttnttt

SEQ ID NO: 4205 - DNA, 828 bp, Homo sapiens
  misc_feature (1)...(828): n = A,T,C or G
nnnnnnttntttaagaccagctcttgttctttntgcaggatcccatcgattcgaattcggcacgagagaagctccactggcacttttgtattcacaactaccgggtgcgataaggcagtgagggttattatgataccccttttcacaggtaaggaaacaaggctcananaggttcaacaacagagtcataattcttcttgttggagaattcattttgntacatttcattcccaccatctgcagtaagggagacccattaaaatatactatcctgatttttaaagagaaggtaacattaaggccnnnaggttngggatntnnccaanttcactntgggcttctggactcccatgcccaacagcctgcatgatgcanaagtgtccctcaagagcctagtgnatgattcttttttngtgccanganacagactgtggacctggagagggttngggggctggagaantagaggaggtggantttctacaacaggggntattgngggggtantaagaccaatgactacataagggcctncgtttggtcttngnccagaaaaatgcgtctttagccttttaacgantgcngtttncctccattanataaccagntttaagccacnggtgttgngntgggcaccattccannngctttngggcncatggtnttntaaaccnaagtccccctcnatcaanngcttnnttaannangggngcctttgannttntttttctttcctccagnnngaanggaacntgttngggctnnntntgcctttttggnnnaaaaaatttttttttnccgggttccnnaaaaancttngntnnnttn

SEQ ID NO: 4206 - DNA, 834 bp, Homo sapiens
  misc_feature (1)...(834): n = A,T,C or G
tncaatncnggctctngttctttttgcaggatcccatcgattcgaattcggcacgagcggacctctagtgcctgatgttcactttcttcaggtcctcaatttcctacatttaagctgttcggttaaacttttccatattcagcttgagatcaacctcctttacataactgattatttttgccttgaggagaaaagatgacgctaaacacagcacacatgtgtttattatatgttggtaatgtggaattcaaagatgaaagagacgtgagctgcatcactaaaaaagaaacatattacataaatgcaatgctgatatcatagataataaaattaacactaattttttgatattatcaattatgcagtccataatcagatttgttttgtgcttagaaatgactttttacagttggtttgttcaaatccagatcagataagtttcacacattaaatctgtttaaaaaccaatttttaaaacagacgactgttaaagggccacatggggaagctttatggaatcttccaacaattttgttgtcccagctacttgggaggctgaggcaggaggatcccttgagcccaggagttcaagactgggcaacacaaagaaaccccatcttttggctgggtgcggtggctcacacctgtaatcccagcactttgggagcccgaagcaggcggatcatgaggtcaggagtcaagaccagcttggccaacgtggtgaaaccccgtnttcactaaaaattcaaaaattagctggncatggtggcgtgcgtctgtaattcccagcttcttggaaaggttgaggcnnaanaatctcttgaaatccagnat

SEQ ID NO: 4207 - DNA, 782 bp, Homo sapiens
  misc_feature (1)...(782): n = A,T,C or G
ctaatnctnggctactngttctttttgcaggatccctcgattcgaattcggcacgaggacacccagtttaagggacattctgtacggtgcctgaatggcgctcctgaaaactgtgcaggtcctcaaggctgaggaaagcgtaaactgtcccagaccagggaggccaaggaggcgcgatgactcaatgtcatgtggtgccctggatgggatccagggacgggaaaaggacacttgggaaaaactggtgaagttcacgcaaagtgtccgggttagttcagcatcagagaccaatgatggtttcttggttgtgacnaaaatgttccatggtctgaaaggtgtcaacaccaagggaagctgggtnagagggctaccagaatcctctctactgtcttttcagcttttcggtaaatccaaaagtactttcaaatgaaaagtttaatttaaaaatgagaagccacctcccccacgagatcatgaagctccatgaaggccaaggccatgttaatgccaaatgcatgttggttgaattcactcgtgtttggttgaatttactgatgttggttgaatttactgatgttggttcaattttactggatgttgggtgaaatcatttcatgttggttggaattcacttattactgnggtncttaccatcttngttgcagccctcttcattctttttttctnaatggncaaacaaataantnggntgtanttacatatttattgggngtntaaatggnggataatttaatattntgtttttaaatgnnggnatnaat

SEQ ID NO: 4208 - DNA, 882 bp, Homo sapiens
  misc_feature (1)...(882): n = A,T,C or G
atnnnnnntttctaatacnnggctactngttctttntgcaggatcccatcgattcgaattcggcacgagcaaataagttaaatgtatatggcattggattggaattggaggtatcagtgtgaactcatggttttgggttttttgttttttgccttttttgttttgtttttgttttttgaggcagggtgtcactctgttgcccaggctggangaaatactcannaacganacnctatngtgtatcanaagctgctacgcntntcatggntttgttanngancnacacagatagtcntnntgtattcancgacttannctananagagacagnatgggaattaantgttaangtgctagccaacaagtaaagattcncataaaacaanggtnatatncccagtcatcaaagtgataaattttccctgctaactttagattaaaaagtantttttangccannttgtgngnggctcacacctttttntccctncactttttngcaggcntnanggttngacnanatcccctttnacnnttcangaantnttcnnnnaccctccccttgggcnanncantggntcgnaaaccccccatcntttttccncaaaaaaattcccaaantttcgcngccacccggnntngnnntnccgtggtanccntgattnttttcncncttccanccggnnnggncncnacngccananaaaaaaccttcnttntanccctngnngaggccncnngtttcncnatngnncccnnaaaattggggtcttttagnanctcnttacccctngccnnncnganttnaancnattctttnaaataaaaaaaccctccttaancttattatngagtccgtatttncntancaacccntacntc

SEQ ID NO: 4209 - DNA, 881 bp, Homo sapiens
  misc_feature (1)...(881): n = A,T,C or G
nngnntnntnntttctaacgttggctctcgttctttttgcaggatcccatcgattcgaattcggcacgagagaaagattttctttattaatgaccccaaccgtatttctttagatacaggagttttgaactcaaatacttaggagaaaacaagttatgactgcattatcctgcaactcattaccagtaatatattgcaaagcgaaacagcttggaaaagagggtgggagaaaagggaagtgagggagggaagataaagaaaaggaattaagttgatcaagtggaattctttttttttttttaattcttgggaactatgaagtctttgcaagcacagctcgtttctgcagattattttccaaacgtgtacaaaatggaaccaaaacggagaatcccttaagaacctgaagaggcgcaacattaaaagctacgattatccagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatcgtgtgtgaatataggccttagagcacttgatgtggtagtgcaggtagtcccggaacgtgtggatcaggttgatggtgtttgtctcgagcncncnnnntnnntnntnnnntnnnnntnnnncnnntnnnctcnntnnnntnnnncncttncctnnctctnnctcnnctcnctnctnnntctnncnncnnntnntttctnnnnnntttnntnnnctctnnnnnnncncnntntcnnnnnnnnnnttnnnnnccttttnnnnctnnnnnnncnctcnncct

SEQ ID NO: 4210 - DNA, 785 bp, Homo sapiens
  misc_feature (1)...(785): n = A,T,C or G
ggnnnnnnntnnnttttaagatcagctattgttctttttgcaggatcccatcgattcgaattcggcacgagatcacatctctcaagttttaaaatgggtttttttgttgttgttgatgggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcncggaccggagggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctncgnccaggctttcttctgcaacaggcgtgggtcacgctctcgctcggtctttctgccgccatcttggttccccgttcccttgcacaaaatgcccggngaaaccacagaaacccgtccctgctacagagcangagttgccganccccagctgagacagggtctggacaaaatctgacantgatgaatcntcccagagcttgaagaacaggatttcacccagcaccacacaacaagcccagctggcggcagcagcttgaaatcnatgaagaccatc

SEQ ID NO: 4211 - DNA, 839 bp, Homo sapiens
  misc_feature (1)...(839): n = A,T,C or G
tngnctnnnttgttanatctngnntttctaatncttggcnatcgnantntntgcaggacccatcgattcgaattcggcacgagccgactacttgtgcagtttgccctgctgagccctcctcgccccgggaggcagaaggggaggggtcctcagcaatatgctgagcacctcctaaacaacatcacctgaaaaangaacctagangaganccattctcaaatctgatcctggactgagctcgagagctgggttgagagctgggttgatcaaagttgggattttgctattattgtgacaaagggtccagccttgcagtccanatcctgaaaggcctgggacaaggccaggtaatttggggagtccntcctgcatttgtgcaggatgttcagcggcatccctggccacccactatgatgcccgcagcaaacccctcagttgggacatttaaaaatgtctccagacnttaccaaatgggacagcattgnacccatttganaagcaccggttgagagcaaatncacaaatntntaaaatgggagatttgggccgtggnggngcaagcctgtagtccaatntcntnggaggccaaggctgggaggatcntttnatccccaggaggtanctttccggnngggcgaataactgcaccantgaactnccatattgaattgaacagaancccangacnctttntttttttaaaaaaaaatatntntntaanaaaanaaaacttngnnncnttnttaaaaanttttatngggangtnggtnttaccgttgaancccccncnttgaaaaanaaancatttggtttaagntttgggccnaaacccacancnt

SEQ ID NO: 4212 - DNA, 794 bp, Homo sapiens
  misc_feature (1)...(794): n = A,T,C or G
ggnnnnnnggnnnnttcnatnnnagctctngttctttttgcaggatcccatcgattcgaattcggcacgagagtttaaaaatacttctttgtaaaagttattgcacaaagaaaagacatgaatgtgtccctgttatgtactcacaaggataatgatggggttgttgctcattaatactgtttcttgtgcaataacttttacaaagaagtatttttaaactgatcattaattttatgaccacagaaatgagatgcaaaatttatgctattgtcagtggcacaggctcacagcaccactgacattttgtgtgattgtaatagaatggctgccaactaatgattctgtagacatttcatttgagtgtgcttttctttagatgtgtgattagctgtaatgctttcacttatgtctgtaaattatattggatatgtttacctgatgcctattgttgatttggagttcagttttgtattacataaatgcaagttgaactttttttttttaatttatagaagtctttgcaggtataactacaaatactcagcccctggggaggaaaaatgctttgcactactcaacagtaacccctgcgttcagttaaaactccttataagacagcagcttttactctttattgggtcgaaaaaaaaaatangggggaggaaaangggatggaccatcctgggacaatggtaagaatgaagaanaccatcttggaaaaatgaggngtccttcccttaatgcaaggttaaaaaggggctnntccttnatatatagcaatatagaatctttgg

SEQ ID NO: 4213 - DNA, 775 bp, Homo sapiens
  misc_feature (1)...(775): n = A,T,C or G
nnttaagancagctcttgttctttttgcaggatcccatcgattcgaattcggcacgagcagagaggcagggataccagatatggggaaatctgtaattacatgcaggcattaaatatttaaatatatattttcttcttttaattgtggtaaaacacatataacataaaatttatcgtcttaaccatttttaagtgtactgttttgtagtgctgagtgtattacattattatacaaccaatttccagcaccttttcatcttgcaaaactaaaactctttacctattaaacaactactccctgtttctccctcctcccagtccatgagaagcaccattttactatcttttctgtgagtttgactctacaaacctcatgtaagtggaattatgcaatatgttgacaaaccaaattctgtacaatatttaaagaggtttagtctgagccaaatatgagcaaccatggcctaggacacagtctcaagaggtcctgagaatatgtgatgtgccttaggtagtcaggtcacagcttggttttgtcattttagggagacagaagttacagacaaagacatacatcaatacccgtaaggcacatgttggttaagcctgtggaaagataggacatcttgaaaccaggccatcacatgtcacangtggattcaaagatttctgattgggtgaaaatctttggttgggtgnaagaagttaagctttgnctaaaggcttggaagtcanggagaaacaattgctttgagttaaaggtaangggggtgng

SEQ ID NO: 4214 - DNA, 797 bp, Homo sapiens
  misc_feature (1)...(797): n = A,T,C or G
tnnnntttcnaatactngctatttgaactttatgcaggatcccatcgattcgcaaaccgganatgggttntttttcgngggggnggganggaacanatttgcattaacaactactgngaattntccatncaangataatctcncatgtcnaanancccntttnttaaatnnngaatggggttgggcttatcagaatanntntttattagaggcttttttncaaanntcacnggttncacctgnaancccccataatnntntttttaancngctgntctanggatgagccccanttanttnntgcaagnngggananacnnnntgtgtnantncanatnntntgctngaaccngnncactnnttcataactagctngancccatttcccgtgnacttcggncgntnnannttnttangccggccnnaaccaatgantaggtgaaaaggacccncatgtnacccccaangnatanaccccatatttccatgaantannaccttnttctgtngggatgccccatcttagaanctntgggncatgnngagngnaagccctgagcatttntntnaacatgcctacttactncncnaanttgcnagggantgtgncngtgccantccatgaatggggtanggcgcagatccncgcaaacagcccanttgntacccatgagatatggaatnttcctnnctatggcaaantaatggccnatttncaaanttgnggacaaantgaaaggacttgtgttgctnggcnnnaaaanagggnggggggtggggnatttttaanaatcctt

SEQ ID NO: 4215 - DNA, 846 bp, Homo sapiens
  misc_feature (1)...(846): n = A,T,C or G
ggnnnnnnngnnnngttcnaatgcttggcaatcgntntntnggggncncntcgagacgctggctcctttatcagatattactggatcatcacctgtgnaggctntntgtttaatgatnnnnancatttgaatggcaacagntgcgnatgnatcctgcctanaancacncntactcgntannnannttggtgtgtgcntgcntctantnnncnanatcctgtgcacacatcggaatttnantagaancagtacagnnncttangcagnataaaccatcctgnggnnananatgacacnctgcnngacntattnnnnncncannntnatggtgntgggcncngnaaaggncttgaaacangtcgtatgnncntnacanggcaccgngctaatatgctactgtgtnaacncaggnnatgagctgcagcnttgcctnncttacnantgctcactgggtgtgaaggacctgcttgtgaggttnntgttngccttttnctggactnannntaanccnntacnaangccngcattgttcattaccantngccttntgaantntnanagnagatgncattgggacnaatnggacagtntaaangannaccgcttngatggagnggacnngaatcgtttcttacntcanggggccactttattaanatgggngaacttnncacntnnngctcctangcncttccaaggtnaccttngggnnccnntggggaatttaaacaantncacaanggtggtctgaaaatcttcnnnggggacttaattnaaagaaattnattcggggttttccngggggttcacccangangtnttnaactttcncannccnnannttnt

SEQ ID NO: 4216 - DNA, 860 bp, Homo sapiens
  misc_feature (1)...(860): n = A,T,C or G
gngnnnnnnntttgnaacnttgctaatgctggctactcgttctttntgcaggcatcccatcgattcgaatttcggcacgaggttgtaccaataaagtttgcaacctacagcaatagccagtcaataaaggaaatgatgctgatgtagcatttatgagccttaaaaaacaaacaaaaaaccttaagatgttaaatttattccaaggattctttttttttgttgtacatgaatgttcatatcaggtttatttgtaatagccaaaacagtatacacctgaatgcccaccaacaagtgactagataagcaaagtacggtacatggatatgatggactacctcagagcaataaaaaagaatggactattgatacatgctacaacatggatgattctcaaaggaatgacgttgagttcagaaagcaagacaaaaaagtacattctatatgattccattaatataaaggaatatattatattcaaggaatagtatataaatataaaggaatattttatattcaaggaatataaatgaatataaatgatataaagcagatcagtgattgccaggagatgaggtggagaagtagagaggggaggaaagaagggattactaaaggacatgaagaaacttttggggataatgtttatgttcactattttgattgggctgatggttttacatatgtatacatatatcaaaatgtatcaatctttatactattaaatatgtgcagtttggttgtaagtcaattatacctcaatgaaacctcattaaaaattaccatattttgggggatctaaaaaaaaaagncttntagaacttanntgagtcgtnttccgtngattccagacattgataant

SEQ ID NO: 4217 - DNA, 714 bp, Homo sapiens
  misc_feature (1)...(714): n = A,T,C or G
gnnnnnttgntcnaaagccnggnnaaggaactcttgnaacncccnnngcaggatcccatcgattcggttttgcccctttttagcctcccagagcttcgaggactcaattttaacccgaaatcctgccgngggggaggggttgcgtcgagacctgggcccggggaggttctcctgcgtcactttctgtcctgaaaggcgcccttcctggtttctgtggctccaattttctatgcagccccacaccccttgttgttttgatcctgagaaataaaagggaggctgaattattcaaatttaaatgaggtttccccttcatggaagtgctgctgacccttcgtgcagaaatggggagcacttgaggacacaggtgggtggaggccctttgtgcgtggctggtcgtattcgggcagccctccgtcgctttttataaaactttgngtgagaagaatatattgataatgtcagtgaaacaagcagacattgaaatggaggcacagattactccacaaggagttcttctgtatattttttctagatgcaaatccntttaatatgnaattaatgtaagntttctagcttatatcgaactgggngnggcacgggggacactgtactggataagntgggcanacatcctgagnncgaatgcctgaccacggaaaatatanaatttattgctttaaaaaaaaaaaccacctnacangggcgnacnac

SEQ ID NO: 4218 - DNA, 849 bp, Homo sapiens
  misc_feature (1)...(849): n = A,T,C or G
gnnnnnnnntttnnaacttgcaatcgctggctactngttctttttgcaggatcccatcgattcgaattcggcacgagaaaggctagctatattagctggggttccccccaaaagcaacattggagaaggactcatgggcagatactttcttctggaaaatgatcccgtaggatatgggtagaaaaagaaattgggaccagaaagaatgaaacaggaaagaaagaaagcctattgaaggatataaaatttctgtaaacaactggagcttagtcccactgaggccccctgaggaactgcgcagaatgtaagacagaggaggaaatatttagccaccagttcctatctcccattggccaacttgatgctgagttcaggagtggtggctcacacctgtaatctcagcattttgggaggccaaggtgggtggatcgcttgagcctcagagttcaaggccagcctaagcaacatagcaagaccccatctctacaaaagaaaaatttaaaaattggctatggaagtatgaaggtatatgcctgtagttccagttactcaagaggctgaagcaggaggattgcatgaacccctgaactcaagactgcagtgaactataactgaacgatggcactgcagcctgagcaacagagcaaaactcttgtctcaaaaaaaaaaaaaaaaaactcgaggcctctagaactatagtgagtcgtattacgtagatccagacatgataagatccattgatgagtttggacaaaccacaactngaatgcagtgaaaaaaatgctttatttgngaaatttgnggatgctattgctttatttngtaancntttttaagctgcaattaaac

SEQ ID NO: 4219 - DNA, 794 bp, Homo sapiens
  misc_feature (1)...(794): n = A,T,C or G
gnnnnnntnnnaaancagctctngtttnnaaaanantgctacttgttctttttgcaggatcccatcgattcgaattcggcacgagaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggganggttttttaattcgcgggccgcggcgccaatgcattgggcccggtacccaacttttgttnccnttaatgaggggttaattgcccccttgggggaaaanatgggcatagnttgtttccttgggggaaaatggtattcccttcacnaattccacacac

SEQ ID NO: 4220 - DNA, 825 bp, Homo sapiens
  misc_feature (1)...(825): n = A,T,C or G
atanagctattgttctttttgcaggatcccatcgattcgcgcccctgcatgatggcagccgcactcctgcccagagtggggcctgggaccccaacaaccccaacacgccgtcacggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcanaactccagcgactgggtaaccactgacnttcaggggaaggngcgggacacntacctgnatacacaggggggngggacaaaacaggtgttatccnnnagttgncacnggtacngtgggggcccaagngtgggnggnntgaaacagntntttttttttntttgnttncccccttaaaattggganaanannacccttttncccaaaaatgggnganaaccccaaaantngggcaaaaaacttggggatttgggggaaaacccttaaanggggcaaggggggagcnttttntgaaaccccaaanggnggggntntttaccctggatttaancgggggaaatnaagggangggctttcctttggggaaaggganaaaattttgngcccaaaaaccttgt

SEQ ID NO: 4221 - DNA, 819 bp, Homo sapiens
  misc_feature (1)...(819): n = A,T,C or G
cgnnnnnttgttgaaanagcnaggctactngttctttttgcaggatcccatcgattcgttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagcccatttcatttgttcttcacaagctggaacttttcttgtaagctaaatattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttataatttctcatggggaagtttgngggttgtcacaaggttatgggcggtcccaagcaagtttaccaatatttttttagaaataatnacctccccagaaaatatttttnaaaaataagggaccctttcnttttaatatggnaaaananaanaanananaannnnnnntnnnnnnnnnnnnnnnnnnntnnnnnnnnnntnntttctnnnnnct

SEQ ID NO: 4222 - DNA, 766 bp, Homo sapiens; identical to SEQ ID NO: 4201
  misc_feature (1)...(766): n = A,T,C or G

SEQ ID NO: 4223 - DNA, 873 bp, Homo sapiens
  misc_feature (1)...(873): n = A,T,C or G
gnagnntnnnnntttgnaacnctggctactngttctttttgcaggatcccatcgattcgnattntgaacaagctgtntcgtgtgtacagttgctgctgtnattgagccagcagtgccctgncctgccctgcanngtctgcacagctcccactgcttctatnngntgttgggcncgtgaggcatgacttggangggggcctggtgcctgaggacctgctgaagagaatgctcaccaccagctctntgntnccctttctgctttggnaatcaacacgtgtntgcctgcagtggccgngaccgtgactgtttctgcccttgtgcctagttaanagccttcaaaagcataatgaacactttngatatgatattggaactttagtaaatgctttacttccctctaattgcccncaaatgccttaatnttgtggactgtttatttcaacaggtggaagtgttggtcntgcgaaatcttggtnttcgcatttcaagaagggagtgctttattanttcttctttctatggaacgtttcaagtgattggatntaaagaagggctctgaagcaggagttnncacctgctctgagggaacttggggctccagggacgtaccccaaatgtgcgcccagntttgaaactccctgacagcctgntactacntagtgggctcgagggtttncannatgaagaagagttgtncccctaaaagtggttgaaaccctgtggctttcaaagcaaaggtacccnttgtcccancattnttnncgnnaggtaggggnctcattggaaaacntgtngggcaancctgntggtttttggtcccccctgntngtnacaatngggaccttnttttgaacngtnnggaangggctannt

SEQ ID NO: 4224 - DNA, 776 bp, Homo sapiens
  misc_feature (1)...(776): n = A,T,C or G
caaancagctttcngaccccttcggacccatcgattcgttgctctatgtgatgtttattatcaaatacatataattttgaagattttaatgaatgnnttaagattttatctttgtgtagaatgtggctaaagaaaccttagttgagattcaagaagttggtgtctgtttctgattcttatcacaacttgctacttagtgtctaccaagtcctccacctctttgctcctcaaagagctgtgaaaaatgatggcaggagccggtacaacaccacagacttagagaagggcacagtgctgctttattgaatgatctaccaaggtaaaattttgccgggtcaagaaatagcaatttaatccatttaaaggaatgaatataatttgaaacattaacttatttcaagactaacatctcaaagtgttgagaccttttttaaaagagctttctggattttgagcatactttcactggctgtgatttataagaatttgtggtttgnggagtactgcctaaatgccagggtaaaataaggcagncccatgccttacctgccctgggctcanggcctcacatccttttggtacgcacatcttttctcttctcccttgntctgctctcccgcagcatatacctcctagcccccagagcaaannnnnanaaaannannngnnncnnnnannnnttnnnnnccnannnnnnnnnnngannnnnnnaaaaacnnnngcctttnaaananatnggggggncnnnttnccgnnaacccccacnnngtnanaan

SEQ ID NO: 4225 - DNA, 869 bp, Homo sapiens
  misc_feature (1)...(869): n = A,T,C or G
gagtnnnnnttttgnaaccttgctaatgctggctactcgntctntctgcaggatcccatcgattcgaattcggcacgagagcagattcagtgtcgatgagagcctgcttcctgcttcatagatgatagaagtgcaaagccagctgtctgggccttttttatgatactgatcccattcatgaatgctctgccctcatgatcatttcaattcccaaaggccccacctcctaatattatcacagtgataattgggttttcaacacatgaatttgagagaaacacattcagttcctagcattagcttgcttatatttatttcatctcattctctctcatagcttttatttttgtttcccctgtccaatttattatagttttttgtctttttataacttttaaccatcttttaaatttctcttatttatttctctttttactgttgagttacaactctcggcttattcagtggcaaagcaggaagagatggcactgaggcatcttgatcctgaaggatcttttaattcctcttagcagtcttaacattttttccatcagcccctgctatagtttgaatgtttgtgttctctttaaaatccatgttgaaacttgatctccaatatgacagtggtaagaggtagggccttatatttgagagcactacagggtgagtacactcaataataatgnattggatatttaaaataactaaaattgtataattggaaatggtccctaaccccaaaggaaatggataaatgcttgggggttgatggatacccccaattaccccttatggngantcatttacatattnaaatgncttggatcaaaaccattcaccancattccccaccattaaatgntntnncn

SEQ ID NO: 4226 - DNA, 763 bp, Homo sapiens
  misc_feature (1)...(763): n = A,T,C or G
tnaaaatacaggctacttgttctttttgcagggatcccatcgattcgaattcggcacgagagggacaaggctataaatatcattaataccaggttcaggagtttgcactgcactaaaaatcaactcagctatttgagcaccttttatagagtggaaatggggttgggcagtagagaagagcacttttagagaggcttttctgcagtagtcaggggttacacctgttaaccagccataattttttttttaagcggctgtgctgaggatgagccccatgtagttggtgcaggtggggacacactgcctgtgtaactagaaaaactaggcatggccgggcacggtggctcacacctgtaatcccagcactttgggaggtcaaggggggaggaacacttgaggccagagacaatataatatataatataatatattgaccagcctggacaatataataagagcctctctgtacaatttaaaaactaaaagcctggggtggtggcacatacctgtagtcctggctacttgggaggctgtggcaggtggattgcttgaacctaggagttcaatgctgtagtgagctaggatcgtgccactgcattccacctgggttggagtaagaccctgtacacacacacacacacacaaaacaatgcacaatgtgcatcaaaagggaagcgaataggctctgtagtaggtggcaaaaggtggtggtctgggaaacaaggccacctgtggtgtggggtgggaaaatgtttaaaccctt

SEQ ID NO: 4227 - DNA, 865 bp, Homo sapiens
  misc_feature (1)...(865): n = A,T,C or G
gnnnnnnnnntttnnaacttttcaaatatcngctacttgttctttttgcaggatcccatcgattcgaattcggcacgagggccgctgcttctttcccgagcttggaacttcgttatccgcgatgcgtttcctggcagctacattcctgctcctggcgctcagcaccgctgcccatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaatttttttttaacaacattaacttgtggcctctttctacacctggaaatttactcttggaataaataaaaactcgtttgncttggcttctgcaaaaaaaaaaaannnnnnnnnnnnnnnnnnnnnnnnnnanaaaaaaaaactnngagccctntanaactnttnggggggccgnntttaccttanaatcccgnaccttggattangnatnccntttnt

SEQ ID NO: 4228 - DNA, 1228 bp, Homo sapiens
  misc_feature (1)...(1228): n = A,T,C or G
ggccngtnccccttattggaacctttctaatgctggtntantccangtaccnntcgtacccacgattcgaattnggcacgaggctccacccagttctcccagttcntnatggacgactcgctactgctggcctngggggtgttcctggggccgcacaactcctnatccggcgagattgctgtcatcagcctanactccttcgcgctgctgtcccgcntgcggaacaagncctatgacgngtttggctgttggctcacccnngaccagcctcatcttnnggaacctgcaccgnattgnanatatnacctnctgctntgtgctgnngcttaacnttgnctanaacnatgtggagtnngagaacgtcaacgnggtgaagcnggctgnttaagatccanaacctcaatgncngcnncgtccgcacggtgatggtggcccgnctgcanccgnttcnacagtcctganttaaaacagttnngcctaccnnncaaanancnatncatantnctnatntctnttntttncttcnaanntnncatctcnntacttanaatttcncttncnaancnttttcntnntttnntnntancntnttctnnctcctcccnnntctctatcntgannttcanntantcttnnnntactacattcttcanttcatantcnctcananttnnnctcntannntncattatccttnctancnnanactcttatcaccntcgcanacanctantnncntntcacncnatcttctaatanacatncctcctctcgcncatctctnacnctgtaacntctatatntnnttcnctgcatnctnaataatatatntacactcannacaanannacanacaccnctcatnttcatacttntnaannctccnctcctcatntnttctcgtcttntacatactcaactactctatatancgtngacncnggnnatctctncgaannttctcnctcacttnagtcacnattntatcactntcacttcatntcncgtctccntctaacannnccattaccntcantngtgntnttnnctcnctcactcnctntacatcatnnactnntctantcatgctnanatatangtcncttcanatacnncgntancccngnnatnttntctcanaaccacnnctctatntttattttcgtacactgcaatcncataatcttcggcatcnttccatccgncatctncnnnnnatatcanntnt

SEQ ID NO: 4229 - DNA, 920 bp, Homo sapiens
  misc_feature (1)...(920): n = A,T,C or G
gngnnnnnntttgnaacttgctaatgctggctactngttctttttgcaggacccatcgattcgccaacatggtggtctcaaactccccacctcaggtaatccacctgcctcagcctccaaaagttctgggattgcaggagtaagccaccacacccgtcctcagtgcctggacttctgcagtggacttcctttaaaaatcctggaatatacactgcagtagaagaacaaagcatacttcagtcgtttaaggctgaggtatgctttgttcttttactgcagtgtatattccagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaanaananaaaaaaanctngagcctntagaactatagtgagtccgtattacgtagatccagacatgatnngnatncattgatgaantttggacaaacccncaacttngaaatgcatttgnaaaaaaaatgcttaatttgnngaaaatttnngggaanccntatnggctttcantttngnnanccnnttntnnntncnnggcctttanaccnangnttanctaccaaccnaattngnnattnnattttnnantggtntnnaagggtttnaanggggggnnaangnttnggnaaggntttttntnaanttnnnncgggccnnnnntnccnaantncanttnggncnccnngccncccanantttttngnncccnttntatngagngggtnaanncct

SEQ ID NO: 4230 - DNA, 810 bp, Homo sapiens
  misc_feature (1)...(810): n = A,T,C or G
gnnnnntttaannnnnnnnnttttnaanatacaggctcttgttctttttgcagggatcccatcgattcgaattcggcacgaggtgattcctatttcaatatgtgaaacacttaaccaaagaatatatttcgatgaatcttaaacttgccttaaaaacagaagaggttaaaaagaatttagaaaaaataaagttttagagtgtttgagaatgtgtatataaaatattttcaaagccataatatggatgctcttatggctcagaagcatgcctactagaacacgtctcggaatgagagatgtttaattctgtcacctcccagaaagttttgcagggtttctcacttgaatttgcttccctttgcaacctcttgtcctgaaggcccccttcccacctggaaatgctgaggcatgggtgtgataagaatcagtcattttgaagagaataagatgatgactttattaacatttccatatatgctgattgtgtgtgtggcggggtgggggctggggtggaggcttaaggcaaaagctagaattagtcatatgaattatgggcttgtttggagacccacctgaggctcanccctagccctcacccacctggggagtttactacctgggggccccccttgnccatgcctccacttccaaaacaattcaattgctttttttttgggtnccaaaataaaaccctcagcntagcttcttgccnannnnaaaannnnnnnnnnnnnnaaaactcganccctntaaaaactataagtgaggtcggttttaccgtagatnccnaaccttgataagaaaacattg

SEQ ID NO: 4231 - DNA, 810 bp, Homo sapiens
  misc_feature (1)...(810): n = A,T,C or G
gnnnnnttttcaaatacngggcctcgtgcttttgcaggatcccatcgattcgaattcggcacgagagtcattacaagttaggatcctgggtaaatggcaacctccacctcccaggttcaagcagttctcctgcctcagtcccccacatagctgggactacaggggcacaccagctaatttttgtattttcagtagagttggggttttaccatgttgaccaagctggtctcaaactcctggcctcaagtgatccgcccaccttgacctctcaaagtgctgggattacaggcatgagccatcacgcccggccacgctgttggttcttaatgacacagcttaactttattgtgaaaagattgcagcaacaaatgagattttacctgtatttgttaaaaatgcttatccttgtctaagactggcaacataagcagttcttaggcttctatgccaatggacactaggcagtaatacatgtgcagtgctaatagaaaatattggagtaagggtgtactaaggaagttctcaatctttccccttcactatcttctgtaatgtaacttcaataaatgtgattctcatcttggcacaaaattgggaaaaaaaaaannnnnnnnnnnnnnnnnnnnnnnnnnnnnnnnnnnntcnggcctntaaaactttaggggggtcntttttccntnnacccnncnccttganaangaanccnttnggnnggngnttngggcccancccccaacntggaatngnnngngaaaaaaaaaggntttttttnggnaaaattnggggnnggctttngnnttttttttnnan

SEQ ID NO: 4232 - DNA, 794 bp, Homo sapiens
  misc_feature (1)...(794): n = A,T,C or G
caaatcnnagctactngttctttttgcaggatcccatcgattcgaattcggcacgaggtcatgcccggctaatttttgtatttttgtagatacagggtttnaccatgttggccaggctggtcttgaactcctgacctcaggtgatcacccgcctcggcctcccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatacagtgtgcttgcttttgaattgnttgantgttaaatggccgtaactgattgnattttcgttaattgttaatanataaaccagatgttctgaaatctgttcttaaagcagntgccctcaatggtgnttttgcctncctgcttctgagcctcttgggnttactggagagtacaggtcataaagagacctgaactcttgttgtatcaaccattatgtcatcctctnactgccaacattttnaaacagactgaggtntgcctttcgtaanaaacatntacttacatattgccattccttggnttacctgggggaaagcccnaatcgttnttaggacttnananggaganacacaggtctnttgaaanggatgccgggggcttaatnaaataaaaaacttttggntcaataanaagtctggnattaaaaacaanattaattcaacatttntggnagaaggnaccttggggcngggaat

SEQ ID NO: 4233 - DNA, 927 bp, Homo sapiens
  misc_feature (1)...(927): n = A,T,C or G
nntggggntttcnnnncntgggatactntctctctgnaggngncgatgggattcgaattcggcacgaggcggagnaagaggggtngtnggttggaaggaggaattctcctttagggaagatgtctgggaaggnctntctgagagagtggcctttngaaaggagaccctaattggntgacggatgagaggctgaaccatgtaagtatctggttggaaaacattncaagcggctncaganggtntgtgcaaaggccnttggacanggtcacccnngnttacatggccnccntnagccagcctnntaaagnaaagggtntcatnaacaaattgcnnaaancctnnnnaggttngncanaggagggagaggcnntggaatgttttgctngaatagggttagtagtgcccctncatgattgaccagttccccctctcnanaatgttncctnactgncgcaggtttatgtagngggggnctgccntcccatanttngncccctctntancttggnccntgggntgggatgaangtncatccgannacanctttttanagttgcccnnctgtctcnattnacnnatnacccccnncgaaactttgtctcccnancaccccaaggatttcccttngggtatcgncnccanaanaaagcaannngtnggatcaaantaatgggcncccancantttttgaattatnctacncctgnagactcccnttcanttngcnttttaaaaanccnctttttntnncgggntngggtgcaantnnctcttnaaattctaaacnnatcttgnnnacccccncctaaacntggnnnnggncccctaanctttccnacttcaacaaaanngtgaanttgcatattatcttncattttggntctntaangacccnaatgcnnggngntatnannncanannncnncn

SEQ ID NO: 4234 - DNA, 809 bp, Homo sapiens
  misc_feature (1)...(809): n = A,T,C or G
ggnnnnnnngnnngttnanacncccnnnnnttttcaaatnctaggctactcgttctttttgcagggatcccatcgattcgaattcggcacgaggtttagtcttgtagctgtatagcattccattgtataacttataatttatttatgggttgtactattgatgaacatttgagtagtcttcagtttggaactaccacatatggtgctgttatgaatacttttgcacaggtatgtgaacacatgtacacattgcagttggtatatatacagtactgaattactggcttataaatatcattaaattttaaaaacaaaattaattgccacaagcatattattgtatctttgaattttaaaccaaattaaaaattctatgagttgttgaatattataattgtactattaagtttaaattgtctgtgactatagctataagacgatgcccatggtactttgaatggcaacactagcaaaataatattctaaggaagagggacangttttgggggacaactancantgtctgtagcataatatagactacaaattgattactatatcacccatgaatttagctcagactcaaacacaaatttantttctttaaaaaatagaaagtccatttatntttaaatggggcctgattttcnnanaaaaaacnnaaaannanaaaaanccgnccctttaaaactataggggagtncgttttncttnaatccagaacttgataananacattgttgagtttnggccaaaccacaactagnatngcantgaaaaaaaatgcttttttttgggaaatttgggat

SEQ ID NO: 4235 - DNA, 853 bp, Homo sapiens
  misc_feature (1)...(853): n = A,T,C or G
agngtnnnnnttttctaacgntggntactcgntctttttgcaggatcccatcgattcggcacaattggtattcaaacccaagtctgtttgactcccaaacccatactttgaacctgaagtctgtactgctgaaagtttctccttattgaagaatttatattttgcattaatttatgtcttcagaattatacaaagtattgggccacaccaaatttgagtctggtatagtagccttcttgtaaaaaattatatcatataacatttttatgactgtgaagacctcttaattcttcaggaaggagggccctttttcaaatcagacatcctggggtttttactgaccttatttcattctctgaagaatgaaggaatttcccactttgtagtaagtcatggaatgtatagcattccttctatagttgaaccagataaatattagcaagtctgtttagaatatgacactggaagttttttcctgtctttttttaaaagaggtttttggaattatagtcaatctgaaacttggtcttactaataaagaagtgaaacctaagtgagctcccttgctccctgatggctcttggtataagtctcacttaagtttctctgacgattttcagggttnatttttgtgagtgacccaaggaacggtgtattttgatttgaaaactgaatggntggaggtgtgtattggaagcaatagtctgaatctttttgggggtnatatactcctttttgaagctgatgaaagcttnggnaaacntcccanaaaataaacccttaatccngcncatnaaanggaannttngcatttcnnntttnngcngacccngntnaatatncaattnttnnn

SEQ ID NO: 4236 - DNA, 787 bp, Homo sapiens
  misc_feature (1)...(787): n = A,T,C or G
nnnnnttttaagancagctcttgttctttttgcaggatcccatcgattcgcttgctcatcctcatttggtaaactgctacgttaaatgtttcaggtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactctgtctcatgccttgatagctttccaaaatgaaagttacttgaggcagctcttgtgggtgaaaagttttttgtacagtagagtaagattattaggggtatgtctatacgacaaaaggggggtctttctaaaaaaagaaaacatgagcttcatttctacttaatggaacttgtggtctgagggtcattatngnatcgtaatataaagcttggatgaatgttcctgattatcttgagaaaccagatnttgaaaaattgnggtcgggccttaaataatttcgntggacatgctgncataacttaaaatat

SEQ ID NO: 4237 - DNA, 819 bp, Homo sapiens
  misc_feature (1)...(819): n = A,T,C or G
nnncgnngtnttnaacnnccagngntttagccnagctatcgntctttatgcnggancccatcgttcnaattccgcacgagaaancatcaaggtggctgnttgnnagcantgatgatgacgaatctgattctnangatgacagtaatacntnaaaattnaaccncaanttnngggcngagctggacaanaaggttnntgaanactnaanatanttagacttncctnntgtnctnattttttgacataggtcctnaaatctggntnaangcaggcgccccttatcctacnttatntcatcngggngtctantaggagagtgaganttntgtgatccnntntgattgggncannngtagatggaggcggctcacataccaatgttggaatntaagcagtgcggggaggtntacatnngcagtnctctccncaagctaattcnnggngcaggggcnatnatncatggttnttgtctgtctgtggaaacaatgnatttangcnncccnnctggcacnnctgacagatcttcggatgntgctcttgtntctaaaaactgggtgtcnagangaacactgatgtatgtanatgaaaaaaaatnctngcttaggganngnggaatcttgctgaagngaaaaantnaaagncctngantttttttncaanggnntnttgcnaaaataannttaaacgaattgtacnnaacacntgaaaccgtangntggtttttnantttttnggggngntnaaannnttttggtccaannnnggcatggnccttncccctttcntatttaaaaaaggnttcggtancncaaaangaat

SEQ ID NO: 4238 - DNA, 1421 bp, Homo sapiens
  misc_feature (1)...(1421): n = A,T,C or G
gngngnaacacngaanancgaaaccnannaaacggcncnaanancnggnaaanacangcnncggnccncgncangaacccnttgcaacnnncctntangcagancccancganncgngtcngnaangccngctgcntgggaggccaggggcaggnntaattcncntganannnagancaggnngaanannnngccgggcngggnagaagnnnaacggacaatgncacattcaaagcanganccacccananagcgnagcannggnngaagccagggaanggacncnctgncanttggaaaactngggaagccngaaggancgaggggccctgccggnccnacaanagnagctcantngaagggacgtnnacncaanngggacgcnagaacgcggccaancaagatacgaaaggggaaannccggnacgagagcccngggnnacggcncncggaaanggctagaaaaaagaataaaggggnaanngatcgnaggnatngagggccatngggancacaggcncaaaagnggccancaaagancacagnggaagngnccanagnactncgggncgggagatcagggggngataaantgaataaccaaggccnanggacncgaaaaaaggngngnccaaaaangggggnccnanaaggggggagcnnccaaagaggncaaaanaaaatngccngaggggcnagagaaaccncccncagaaggangggggncaanaaaatcnaaccnnnngggnnnaaangnggggggggggaaagggacnntcaccaaaggcnncanaaaaannngaagggncnccccccnncaaaaangnaaaaangggaaaaacccnatntcnagttcaggnnaaaaagtnggggggaaaaggcccnaaaanaaattaaattnaaggangaaanccnnngagannaaccccccanggcaaatngggccaaacatgggnncacncgggccnnggggggcatngggcccccaaatnggncccccccnaccgggnaaaggggggcaaaaaaggancggggnganaaaaanggncngcctcccatagggcaaccatntgcacgggggccnccncaaattngggnagggnaaanncnaantcgcncaccaatgttaangggaaaagcaaccggcaaaagggccatnnggaangangccccngnaaaccaaanagacancaggntagtgaaccttccnaangggaaataagatnccggnaaaaggcaaggncgnaaagaaagtngaaanccgangnaaccnganganaaggcnnaanangggaancnattacannncnaanaagnaggcaanggntgnggaaagaaagatccaaagcccnngggnngcagnatgccnggnaaaantgggaagntannangancctgccaaaggcttnggaaaaacnncc

SEQ ID NO: 4239 - DNA, 864 bp, Homo sapiens
  misc_feature (1)...(864): n = A,T,C or G
gnngtnnnnnntttncaanntnggctacttgttctttttgcaggatcccatcgattcganntncnaggccggggncctgtcattntngatcatnatcttnngntatgaatnggacctttacagtcactgacaggacaacaacaggctggagtnggngcccatnctgctgnngtgcctnnaagaccacanccctnanaggctnctggtcctgctgtgcatngcccattggatgccgangggctnatnactcanactagtacctcacntgatcagatgncagaatcaaccaaatnntgcagatttcagtcngttgtgaagtatttgctgcatcaacatgtagaacgactaacattcatgatgaagccgagaaacatncacaagtcctgncggctnaaaaagcttatgatcctgcacgntntctnatagtnggctaaacagatggtataaactgacgaanagacagctgctactgctcctgccaatgtgagcaaaggcacaatactacttgctccaggacctaaacctgttcgaagaagattgtaaattggaagatgaatttaggccagaagtngatgaacatacncaaaanacgggtgggcttagctgctgnncntgcatcacaacctnntnttnncagntctgctgggaacgataaganngtnttcangcatcaattagncgtaataaggaaaccngcancgatttngnccaaatggnatagcctattgcagggncnaatttaaaggatgtncttnnngaganaaattacctgggaagttcaactgggaacaacntcnaaccattntctnacctataagccaantggccgttaactgtgaacatncttgggttttaaaanngcnt

SEQ ID NO: 4240 - DNA, 468 bp, Homo sapiens
  misc_feature (1)...(468): n = A,T,C or G
ntccttttgantacntntacaagctacttgttctttttgcaggatcccatcgattcgaattcggcacgagatttcaacatactgttgtctaatcatcgtgactcccccaatttctcttttttagaggaaagtattgtacagatgtatcttgaagattataatcttggttgattattgcctattctcactttaggaatagatggtgatagcttatgacttgtgttgtataacgaggtagaaatattgctgncttctctgacatagcttctcaaagagatcattaatgtatgatatctaataaaccatctaatgcatgtaacagtgatcagcaaattaataaattagacctctattcatgcttaaattatcaaagctaatatttaaatgagatgttctattttaattaaaatttctggcaccatcgttaatgagacttagaatttcaactagtgtatttagctcttactt

SEQ ID NO: 4241 - DNA, 476 bp, Homo sapiens
  misc_feature (1)...(476): n = A,T,C or G
gtnnttnnnntttgantncaaatacaagctacttgttctttttgcaggatcccatcgattcgaattcggcacagaagaccaagcgcatgcgancctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaagagagagagagagacttaaatgtcatttactgaatgttaacgaaacttgtgttctttatggtgtctaacacaactgaaggcctaaaattatgtgg

SEQ ID NO: 4242 - DNA, 846 bp, Homo sapiens
  misc_feature (1)...(846): n = A,T,C or G
gtntttcncnaanngntgggaactcgctctntctgcaggatccctcgattcggaaatatagngagatgtgggatgtgaatgcccatgaaagacatattattacacttgaatatattcttgcttcactttaccctncataanatgntgtacattagtgctgatcangtttacagagntacatgggcgctttcctaaccattcagtnangaattaaaatatggcattgtataacaactgggaagaagctcatagnggatataaagtagagtagataatgggtcaccttggatagcctctgatacattcttgtatatgggcaaaataatgattacctatacgtgtatttaagcttaagcatcatataaacagtctttttaancttatggtaaantnnatnatatntaaaagctgtgatctctaggnagtccttaagtnattagtacngnacttnaaaaagatttttaataggtccgncaccggtggnntcatgcctgtaatnccagcacttcnggaaggctngangcaggccgaatcacctgaaggtcnnggaanttcgaggatcanaccttggccaaacattggtgaaaaccccntggtcttaaacttaaaanntttttaaaaaanntaagcccnggccnttggntgggnanaggcgnccctggtaaacccnaagctntcctttaggaaaggcttgnaggccanggagnaaattancnttggaancccnaaagggggcanaaannctttncngtctcngcnnaagnaatcgcantcaaatggnaactntcanaccntaanggggaccaagnaancncnnanacnttnattcttcaaaaaaaaaaaaat

SEQ ID NO: 4243 - DNA, 789 bp, Homo sapiens
  misc_feature (1)...(789): n = A,T,C or G
tnananctgntncncnttcaaatnctnggctactngttctttttgcaggacccatcgattcgggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcaacggcctgaaagcctctgagctacctcgactttggacagagtaatgacttccccagaaaacgtcatataagacttttaccagcccctgaangaccaagagggagccattcctttgaactttcatttaactttggnttnacttctctttaaaacttggggtagaaantgcaaaagcccncanaaattgcttttccnttcccccgccttttgaacatgaaggnccttnaattaaaagaagcttcccggaaccattnaaaaaaaa

SEQ ID NO: 4244 - DNA, 759 bp, Homo sapiens
  misc_feature (1)...(759): n = A,T,C or G
nttcctaatgtttcggntccttncttccgcttctaangcttggcgtgcactccagcctacatgacagagtgagaccctgtctcaaaataataatnataatgaactgagactcanaaaagatgtttgttcanggttacaaagctcagacaggacagggcagcattggaaaccaaaattggtctgactcctagctcatgctgtaaatcacggtgcaaggcttctactatctatgttgttcctaaaagaatgtataaatgaaaagatggttaacatattaagcaaaatatgttaaacgtcaaatgaactgtataaacgataaatgctggagagttgaggtggcaaagaactcatgcccgaggtgatctgggaaggcctcttgacaaggtggaattatagctggtttttgaagaatccgaaagtgcttagattgaaaggtgagacatgtacaggaatggtttctaagatgtcatattntatctctgtcctcatcttgactggcactaatgaacatcaaagatttcaacctaaatacattgagtgcccagtatgtgaanggccttatttatggtggtttaaaagctttttaacatactttaaaagaagggactggttaatctncactgnctagatccattagaccccggaccggatggccccangggcctttgggaatggcgtggtgggacagtcttncacttttgcacatacccaagaaaagaatggnccttttgggaattttgcagacctacaatctggagg

SEQ ID NO: 4245 - DNA, 842 bp, Homo sapiens
  misc_feature (1)...(842): n = A,T,C or G
tccccttgaaancccntaaccaggcttcncangncaaacnntttggaaaanccaanacnnaaaanaaangggangggnacnncngcacgnngcaagagantacacagancngacngnttttaacgannatcgnaaaaccccaaatgganggannttgagncacntgcnaaagggcccaactgctcantttaaaaaagagcagngtccgacannngcaaagaaangcagannaagaggcaaggaccccacagaacacatanctgaaaataatncngaataantnnacaacacgggtggggnaattcaannggacgnaagnnngcatccntnnttcctnataancctcaaatgnaatcgggaaggcaangntggccacaattccacaaancaacgggatttaccatnannnctncangatttcaccaggataccatantcaaggagtgaaaagaaaagtggggaaattcaaggaacttgggacccaccnngnnanaccnttaaaaatnaagggactcntcaagaaaagggaaccntnangagtcnnaaaaaaagggaagangaatggaanggggnccataaaggccccnggnaaaagggatncaagnaagaaanaaaaatgcaanttanaaaggactgggaagaaagganaanaggnnncaggcgaaaacagggcccatctaggaanccnggngaaantaantncngncnagaaaacccnnngcaaaaagggnaantcgnnnnnacnnantaaaancccnncaanggatnggcaaannnncnaaagggntagaaangncancngagcgagntacacgnanaaaanncnnataananntaanncc

SEQ ID NO: 4246 - DNA, 740 bp, Homo sapiens
  misc_feature (1)...(740): n = A,T,C or G
gnncccttnnctntacantacaagctacttgttctttttgcaggatcccatcgattcgtatctgtctgtcttgatctctattctagcctctttttctgattggccctctcccctctcttctgtctgattggcctgtatccttccatcaccccatctgtctgctggattctccctgtctgcctgcagtaatgtatgtgatagcactttataaattataaagcactatgttgtataaaacaccattatcactttgtcttccttcttaccttattttttcttcctttatctggcttcccttcttctctctttctctctctctctgtttgcctgtctgcatcccttttggtgattttgcctgccttctctgtcagtcaatctccattccctccctgccagcctatttttctgccatccctcttctctgtctgctcagttcttgcatctctccttctgtgtttccaggtttctctatatttcttttgcctgtgtagtctctctgtcgttaggccttttatctatgcctgtgtgtctcactgtctanctgcttgtctccctgcctgtcactttcattgtggggcatcaagtctctgccttcttctgtctttcaagtacttcaaaaaataaaaattaaataaaaaattaaatccttatgataatgggtacangagaaattttttgtttaatgagaagatataaggngagacaaagaactcaaaattactgtgaaagcaatgaanaaa

SEQ ID NO: 4247 - DNA, 465 bp, Homo sapiens
  misc_feature (1)...(465): n = A,T,C or G
agccttttgcnacncgtttcaactacttgnctttttgcaggatcccatcgattcgccagaaagtgcctttacatttttgtcttggaacaactntgcaatttcatcttgatttaatatttctagtaataaagcatcttccgactccacattcttatctctgggcagacattttattcttaagaattgtagtgnttgatnagaagctnaatggagatgattaacgtgtcaatgattaataattataacaacattcaaacacttagaaattatagnatttcatcanatgtctttttaaagaggcatttctggccagttgtggtggctgacctttgggaggctgagacggctggatcacttgaggtcaggagttcgaggtgagactggccaacatgatgaaaacccttctctactaaaaaaaaaaaatacaaaaattggccgggcatgatggcaggcgcctgtaatccc

SEQ ID NO: 4248 - DNA, 1070 bp, Homo sapiens
  misc_feature (1)...(1070): n = A,T,C or G
gggnggggnnttttttnnaaannnnnnncnntttttttggngaaaaaagtccccgccagggccttacctttgggtntncttttttttggnccaggggaatncccccaatncgggnatttcccggaaaatttccggggccaccggaaggaaaaaaccaaattantnaaaccttcaaaaaatgggccctttttcntaacagggnacttacccaaaaagcctggtcctggtantcaagggtttaatggggtggtttaaaaatccataaaattttctggggaatccatggaatccttaaaaaccttttaaattgggtttcccattttcttacntttacttcnttttactaaacaaaggtantccctggaatgggcctggaaaaaatnccatggtttggnaaaattttggaaaggtttttggaaattttttcccaggaatccaaaaatantggaaaaaattttaattttttccaattttttttaaaaggtaccaaaaaaataatccaagtttggtantaaatcaattgggtaaaaaaaccattaaaaaatttttggcttattaaaaaaggaattttttaaaangggcctaattttggaatttaaaaaccattttaatttaccttaaaaacctctttttggcttangaaattttttttttaggaaaatttcaagccattcggggaagggaanggaaatggtggaccattaaattaaatgggatccgaaaaggcccgaaaaggttttaaaaaaggtttggtggaatggcccntcacaatggggttggggaanggggttaattctaagctttcttaaagggactggaatgggtttggtccacaaaggaagtggtccatcaaggtcataaattngggtnaagacttaatgggcttanaattttatggnatttataccctgatggtattggaattgagatgaatattttatgaaccaaaatggagccattgtgtaagaagtatagtattaaatataagttaaaacttggaattttaaatccttggagtatgtnagcccttcaaagctcttgangctgaaggcccgattntttgcagtggg

SEQ ID NO: 4249 - DNA, 1336 bp, Homo sapiens
  misc_feature (1)...(1336): n = A,T,C or G
aggnnngnnnnnnnnnngnnngnnngnnnnngngnngnngngnnnnggnnnnngngnngnggngnggngnnngnnnnnnnnngannnngngnnnnngnnnnnnnnggnnnnnnngnngnnngnnannnnagangnnnngnnngnncnnnangangggnggnngnnnnnnnnnnnnnnnnnnnnnnnnnnngnnngcngntangntgggaaaaaancccccntttttggggaagaaanannccccccnggnntnctttttttttgggccnngggggnaaancgccccaannccgggggaagggggcgggnnaanatgtgncgggggncnaaccggnaagggggaanggnganagnnnngngggannnnnngnnnggnnaggggnnnnnngnngnntttttttttntnnaanaggccnagncgangnnggggnnnnggnnggcngnnnnaagggggngggggggggggagntangggggcangnnnaggggggncantancnnangggggnngngagaacgnnaaacaacacagggncnnggaanggaggnggnnnagnnngnnngagnnacgnggcgnnnggngngnaangccnncngggggcngggngangngnanancangggnnanagnagangggaggngggaaagggnggggccggaantgnnggagnggcaagggangnnggancggagggangggggcgagaggangagccnatcgagngggggnaggggngacaggaangganaagnangggggnaaggcgngaancgaaggggggggnatgaggaggaganngngagngctggggggaagggggnanngggggggggnngnngagnnggnnagngggngggnggangangatgggagcnaancggtggacaaaacggcggcncaggnggggcaggnanaaaagggccgggagcggngcngngggggaggngcggnggtgtangaggcaggnaaattganngggagacnnggngngcgnnggagggnngaanagngnnngaannaagacggaacnaagtggaggagggggnannnggcgcaggagagngagggngtanggnagananananggnnaggacnggngncgnggngnngagtgagnggcgcganggagngngaggngagcggnganngagggnnggnacggggatggggangncngggggngnnncgcggggcgtggggacnccnggggggggggggggnnaagnnancnngggggngnannagangangggngnncgntgcnggngngggggggggagagnaangagnacgnggggggggnnacgnnggggnngagngcgagnnngcgcgg

SEQ ID NO: 4250 - DNA, 817 bp, Homo sapiens
  misc_feature (1)...(817): n = A,T,C or G
tcngngagtggtatgtctcgcntcnccgaanagcaggcggngcgaattcggcacgagncnaaaacttngnaataanncactttcatttnttttctagattttgtacatctcaggccatatnagcaaagcttgntgatagtgnaggntnctaaacgctgcaaatnngcagnctttaccactacaaagaagtctggatgatggatnctctgctnttngtcaaaatagttactgctgctgtagaaatttcatttttagattnaactgtgntggatgagctatcataattcaagtatacattgtcttagnctatcaaatattcattgtcatgcagtagtagtnaaaacatcnnagatgcagcaagcntattaaganntatttactaaaagaaataggaggcatttacatctttattattgtactcngggatatgcaaacnctnngatantataaacagttatgtcccctataaatcnggtcagcaacctcnnttgattatgctggggnaagtcaaatagtntggaagtaggtagagtnctggncnacaaggtgnttcaaancttaannattnggaacacnggggnccaagggctnnaatcnttaaaaggaaaactggggntttantgcactnaaaccgtttntggngccntanggttcnaaannnccanaaccttgaatnnantgtggtancccctgggncaaaanaaangncgggnattancccactggnncggaanaacaattgcctaaataaaggtncccccaattgaattccccnanaaanggcctnaaaanggntcccctntttccaaagnaaant

SEQ ID NO: 4251 - DNA, 1351 bp, Homo sapiens
  misc_feature (1)...(1351): n = A,T,C or G
ttggnggaaaaccctttttccaangagntggganaaacnccgatcgcccgnaangcgnnnggggcanaaagngcnatncagancgnngnaantnnagccnntttttancncccacgngcaananangcngannaaccngggnatnaanaannggngcccnnngncaaanannnanacncnatggccnngaangnncnacccttacnnaacncaatanccnncganancagaannagntgaaccnnnnncacntnacaaaanntctagannnccgntcacncaanaagncncnnngccannacnnnacnncnanncnancnncngcanggancncacnccccncncgnnnccanacnancangacngacnnaatantncagannacncgagcnntgacntaannacncaantagcannngccnctcgnngnacncnnaactntngnngagcncnnagngntnnnnagctntacgcnncgatagananagcgnaaaacngannnnnnnctntcnanannnagactangacagacnnngncaacacatnnntagaacnnngcacacatntctancgntatcancagnncaggcannnnacacaanagcancacnngantganncacaanaatcacgcntngaatnnncntnnctnannnnacacaaccaanatnnaanaatgnaagnacaccgaacactnnacangcagactanactcngncacnnaananaagaactgacngacannacaaatanaaacgnnntctacatcacagangtacnnncagacanaancnncngnannacaancggcncacacagntanacntntcatagcnntcnancatcccncagtgcacacaagngcncgnaaannntcatntcnctananacggatnccatnataggaacagnnanctgcntacannnctnncaagnaatgnacagatgcncgcanganacgnaagnnncnnnatnctgcatgcntngcnnancaaatggnangatnatcnnanatncaannngcngcatacaanngntcgnctaacacngatctgcatccatngacggatanacgtngagtangcctnntcacctcnnnagatctgcgtnncganatcancacnatangcntnaanagtnnncagaacagtacnagactggnnantnaagntannatngtntnnagtataataanncacangnagntagacnncaancgnngnacnanatnccnngcanncgcaaanagagcanccnnangcgnaccgaccgcagctaanacanacnactntacnncacaaancntnngaggccgntctaatnctncatcnnnncacctgnacgngacccg

SEQ ID NO: 4252 - DNA, 759 bp, Homo sapiens
  misc_feature (1)...(759): n = A,T,C or G
taaanntnatggntggntacttgntctttacgcaggatcccatcgattcgaattcggcacgagggagcccagtgttcctgttcatgaaatctnccttttactggaaaacaggaatattgactaccaaatcacaatgcaattgaagccgtactgcttttttgagcagttattcattccagtgattaaaactgattgtgcanaatattctaagaggncanaaattggngtgtntaactacatttttagtgatgcaattnattgattagtgagtaagatactgagttttattgagagatttgattattataaagtaaaaatacngctgnattagggttacnaacagnaaagtgtcttaatgnctnangagggcatnttanctncactacaaaaccanatnttgnctgtacttntgaanagaatnttgtngntnctcagctgntatncaananctnaggaagnctntatggntgcnttctatgacatgtgnattgtgatntgcatataagnatgggtggngtgcnataccatattctnggttnttaaaatctatcactttncaccttncactttgacgtggtaaaactttaaaaaccaangtgtgnaaacccncnggnttcttaaaatacnaggccttagatcttatcagncgttttgacaaagcaggttttttcaanggntccctcctnananttttttnnaacggtcaaactaangnnntttgaggnaagctcttagtttgaccggaaaagntgggnccnt

SEQ ID NO: 4253 - DNA, 1382 bp, Homo sapiens
  misc_feature (1)...(1382): n = A,T,C or G
nnncggnnnanngaannggngnnnnnaggggnngggggccnnggngannggnnaanggnngnnnnnnnnanngnnggaagnaaggnngggaaaacaggggnaanggnngacaaannnnacnanngnanaanaggngngnnggggngggangaaanagggcgnaaggganggnaaggaanngggannnncgnngnggnnncancnnnnnnnannccnnnnngngggnnccnnttngntgggaaaaaaccccctttttgggggaaaaaaaannccccccngnnngnnngnggnaaannnnagggngaanaaccccnacgcngaaagaangnggaanggnntcanggacnacgnnangggcgancgcccgaggggcannnggggnagcnngcanccannnntttnccaacgaagggnananaacnannagncngcanccngngcagggggngnncgncgangcgcnnnanagnacacacaaactaanaagaannggaaganannaacanannaacgaaangaaccggnaaaaagagacgggcanngcngananaggagcnggacngnaggggganccnacngnannaagcgnggnagnnnggggnggaagaggcngcncggaangcnnnnacnantccgnaacnaaanagnannaangactaggcaaccngaacnncacgacgggnnncnanngcgganncnnnnacnagcgnnngagggnnaagcgcgcgggacnaacggggnccncggannggganngaaaangccgnaacaaaaganggacgnaaaaacnacncananaacggnnagggcccngcagcnnaagnaggngnggagggcagggnangcgggaaagcgggagacgcnnccagcgagaagcgcgcnaangaaanngancgggcnncgcgcngggnanncgngccggnannagaggacnnataggaagtgcacnancaaacgcancggcatcncangaggngangngatgnggatanagngancgngananncnanagaganggggagagnaagnagancgcggaangnacancaangcgnagaaccgngagagcgnnccangcangngagaanggnanngaggnnanngananacggngcgagngangnnnngacacganggacacgcgcggagaganncgcnaacatgaagnaancggnnggatgggaaannnganngananacgganggaancnggggncgagangaganggngaggcncaccnaacacggagggggagcnaggtagnggcannnaangagacgcggacgaaaacggganaaccgaaanggnggngcaanganannangggaagacgcacgngnggnngggagnaaannangngggaanacgaanaaaancgcc

SEQ ID NO: 4254 - DNA, 1245 bp, Homo sapiens
  misc_feature (1)...(1245): n = A,T,C or G
cgatacacatcntnnncaaatgatatcnatntaanatatcaatatnttncntnttnatactctgcaannnaagaaaagananantnaggtgctgttgaanccatnanctcttgtttttttgcagnncccacgnttcgaattcggcacgaggttttcctcaggcacaatgagccactgcaggcttttgaggagaagagtgacaagctgnagagctgtgttttaggacagctatcctagagctatgtgtgggcagagagtacaagcaggttatttatgaggctngggtaaaaaggcagacaggggacacatttgtcatatgccctattgaggcncanaatcanggaacaggaggtctgcnggttncangacaggccaaatcangganaaaagggactatccgggattancaagtcactggtgatcganatatcactttctttgaanntttanaaatggtttntgttancacttgcnannctcttcattaananaacctgccacaaaccaataaanttannngtttaaaatagaatcntgnagttatananancccaatgggaanctnggntaatannttntanngggaanactnttnnngttnaaaaagggaaanntnngggaaancccgntnanangagagnggnagnntntggcataanagacgnggnntctctcctctaaacganatacgaatacctcttncgcnnnntacncnnnnggtgntnnanaaacgntatntttctacacgggantctntgtcgtttttttaaagataatnagnagnacncaatacataantnncaagcncgcgtnanaaananantgnacgctnannataanaactcttntcngtatnggccnctaanctacttaangganaaagcttaatataangntgatggcaagggtnccccntgtagantcnttaccnattgtctcaacgatctccctaacgttatcnnnntngacaccatgacgcnattngangcncacttantntgaacgngtaaaagnntttntgggggtgcnntannaatacnnangtcnncatcncntttnnnggttanantntccncancntngatataaagannaaataantggtgcaacntatatttttcggnnacnnanntatattctctntgggnnatncatgtctncatncgtgcnttatcnatttntngtaagnagaaaccngtnaatntcttatgaannnntntcnntttcgtaatttgaaanaccncg

SEQ ID NO: 4255 - DNA, 768 bp, Homo sapiens
  misc_feature (1)...(768): n = A,T,C or G
aggnggnattaannnnntttttanannngcngctcttgttctttttgcaggatcccatcgattcgaattcggcacgagaaacaatataactcaaatgcctttctacaggactacaaagctgtctgtatcaggttatggtgttaaatcataatttctggatcatgatcttaaacctttaattggttccatttctactttactctttactaacaagtatcctgatgggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaaacatttatttacttaaactctttgctagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattggtaagacttaatggcttagatttatgtattatacctgatgttattgnattgagatgaatatttatgaacaaaatgagcacattgtgtaagaagtatagtattaaatataagttaaaactttggaattttaaataccttgggagtatggtaaagccctttccgaagtctcttggaggcttgaaaggccgnattcttttgcantgggn

SEQ ID NO: 4256 - DNA, 749 bp, Homo sapiens
  misc_feature (1)...(749): n = A,T,C or G
tggngntttanananncnggctctcntctttttgcaggatccctcgattcgaattcggcacgaggtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaatttgtgtttgactaacaacctcgatggatcttcttncaacctnccattaagatcctgcagaagaaatagaaatattcaaatattgcaaggtgtaattgtgagacaacttattataatacgtgttaagttctactgganccatggaaatggtttaagaaaaa

SEQ ID NO: 4257 - DNA, 466 bp, Homo sapiens
  misc_feature (1)...(466): n = A,T,C or G
tgnttcnantnttttacaactacttgttctttttgcaggatcccatcgattcgnattctnnacgaggctgcttactaaggcttnnactgnnanatcgnttgacccnntnngtcgntngctgcacatgccnatattnnnncgacnnngctnnntcctgngcngntangngatgacctgnntcnggacacaatggngaangngtagnggtgcnngacatnggcgaaattgtgngcnactagaantngtgncaangcnngntttcacatancctnnnnnnnctacttgccatnttnnantgancttnctgcctcacnacattcntgngttcataacnngacncnctaagngnacaactccgaacccacattggncaaaaaaaacnacatatgctnacngttcctnctgcccatgtgnncnntnaacttgnatnatcttanactgaaccagngctccacccattcatnct

SEQ ID NO: 4258 - DNA, 464 bp, Homo sapiens
  misc_feature (1)...(464): n = A,T,C or G
tngatnccttcgatcagctcttgttctttttgcaggatccctcgatncggcctatcttagagaatcatctgctcannccttattcctgcagaatacaaatgtcacattctaacctgttcagagattgtcttcaanataaaantgtgattcctacatggnatgnnaaacaanctacactnntnggcaaaaggcattattagggntngattccataatgattgagtnctnttnnnnagtatantcatgcanctgaacaaaatgaagctcattccactgcntngaanaatnncacaaatgtgatgctnaananaggaagccacgtgcanacactnactatataattntatgtacatnaagttcagnatccggatagttaccnntgnnaaggangtaactnnangagtntgaggaggggnttctggtatctggttaatgnacttngtaccanttacccaanagtgnnt

SEQ ID NO: 4259 - DNA, 882 bp, Homo sapiens
  misc_feature (1)...(882): n = A,T,C or G
gnagcntnnnnnttttctaangttggctactcgttctttttgcaggatcccatcgattcgaattcggcacgaggcatcctgtccttgggaaccctttctcattctccaagcctggtcagctgcctgcacaggcagaggtgccctcagcccaggttagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggccttccagctgaggccacaggaaagcacttttttatgatgtactaaaagccacagtatgtggcaactgcaaaaggatcaggaatttagggtatgatctcggtcacgtgtcccgggccgctgaggggaaaggaagcgggcatgattgtagacaatgagggggttctcttgatgtaatgaaatgcaattttatggtttggtgcaaaaactcctattttccagttaattaactttatttctaaagcatatttttgatttnccatcnanagcnataaagcattaaaattctttaaaaaaaaatnatcnntctcnantnctccanatncaaaaaaaacttcgnnccnttnaanacctttttgnggngttcntnttttnccgngannccccnccnttnnnnctnngattccntttgnctgtnttttgngacnaaccccccatactnagantnctccgcaaaaaaaantccnt

SEQ ID NO: 4260 - DNA, 755 bp, Homo sapiens
  misc_feature (1)...(755): n = A,T,C or G
nngtgnantgngatnttggcnagcgccatgantnnnggagtcgancgannnncggcacgaggagaaccncntaaagccctnannnttcctttttttngnangaagngggagtanatggntngcnatntannccnananggcacnntnnanggaggngnaaccactctgacgttnnatnggcantgagagntagancagaggctgncctgcntggaagctgatataccctataatncanagggnnnnagacnantnttgngaaactcggtnanacattctatttanagacatgcctgctgatatgacntatatttttatagggatacccntttatngctgggacatnaancctgnttncactcnaaatgnncctgctttcagaaaatagaacangagacatgccgaaaacagngnttctattattgtgnattatganttttgttctntagaactattttccaactcatctnnttncctgcagctgnggaatctggacagcnaaatcttgtggacgtttattccactaagcccagggatgagatggcactcaggttaaagaactaacattttctgaacccttnattaactatttaccagcatcaggccctctaagtacaagtgtcagaatccttcatttcaattttttcactcngggcattncccattacaaagcccatcctattattgaacccnaanttnagcaaaccacttaggtctgccacttaagaantcngngnnncaaggttgccnaagaa

SEQ ID NO: 4261 - DNA, 738 bp, Homo sapiens
  misc_feature (1)...(738): n = A,T,C or G
tgtgttttctnnctgtggnnactggcctttcnncangaagcctggccggtcgaactgcnancggcnncnncggaaagggnntgnncaanngnaatttntgcngntnangntgtatacaccttggangannnnnntgngcnattgcngntctnngangtattcangncnnntaaattcntcatnanccncacttccatngtntnntcngncacatgctnncantntatnatncntgngaaangcngantatcnatgctagacntnnntgcaggctgnngcnncgganntgtcntgacnncaaactgtttactctnantgactgtgnnggcntttntcnnatgaaaannngggcagtattcccttnctaaangagntcnnaggaagaagatgagaancggggtggnatcagnaactgannnggcacngaagcacgtgnnagaccctcnnanaatgatgtgannggaccaaaagcntgatcaccaagcgctttcangnctggattccnnncncgnatccatannagtcntgtnanccaggaccttnnaggnatcatnnnccnggcgtgtngnnaatgagcatngtgtggtacacttgacgntgtcccctggtgcntactntgtaattcatgctncactagatnagncnagnacntatatncgcttcggcactgtgtgctngtaccnaccncncgttggaccgtnattccccttncaatgtgtnanatnttnggttgggcct

SEQ ID NO: 4262 - DNA, 461 bp, Homo sapiens
  misc_feature (1)...(461): n = A,T,C or G
ntcntngatacanctacttgttctttttgcaggatcccatcgattcgaattcggcacgaggcaattgtctatttatcttttatntttttaagtcagtatggtctaacactggcatgttcaaagccacnttatttctagtccaaaattacaagtaatcaagggtcattatgggttaggcattnatgttnctatctgatnttgngcaaaagcttgaaattaaaacagctgcattagaaaaagaggcgcttctcccctcccctacaccnaaaggtgtatttaaactatcttgtgtgattaacttatttanagatgctgtaacttaaaataggggatatttaaggtagcttcagctagctnttaggaaaatcactttgctaactcagaattatttttaaaaagaaatctggtcttgttagaaaacaaaattttattttgtgctcatttaagtttcaaacttacta

SEQ ID NO: 4263 - DNA, 749 bp, Homo sapiens
  misc_feature (1)...(749): n = A,T,C or G
anngannctgnnggtcgtgtaacgccctttntnnangaagacnggcgatncgaattccgaggatccaagagggcnnnactngggngggcttcntttcagctgaaggctgctaccgtaccgtgtgggagcgcctgggtctggccttccagaccccagaggcatactgccagcagcgagtgttccgctcactggcctacatgcggncactgagcatatgggccatgcagctagccctgcaacagcagcagcacaaaaaggcctcctggccaaaagtcaaacagggcacaggactaaggacagggcctatgtttggaccaaaggaagccatggcnaacctgagcccagagtgagccgtctgaactgtgggagggaagtgctaacagcccagcctncagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctacctgttccctgactgcgtgaaatgttcagggaggtcagttgatttccccaggtacattcatggtgtgacagacacatgggtacaaataaaagacccagaaagccaacnaaaaaannnggttttnanncnnngaattttaaaaanntntaaattncntngnnttaaaaantncttttntgnaaaaaannnttttggccttttt

SEQ ID NO: 4264 - DNA, 747 bp, Homo sapiens
  misc_feature (1)...(747): n = A,T,C or G
nggggtntttatanaatccaggcctacttgttctttttgcaggatcccatcgattcggccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgccagtggccaggcctatgtggccctttctcgggcccgcagcctgcagggcctacgtgtgctgactttgaccccatggcggttcgctgtgacccccgtgtgctgnacttctatgccaccctgcggcggggcaggagcctcagtctggagtccccagatgatgatgangcagcctcagaccaggagaacatggacccaatcctnctgagcctnacccacaaagaggagacaaaagggttggcctgtggcctncccgtcctcctgctncctatggcccanggccccagggaataactggagtaggcaggcagtgtccccttctgtattttttanggactntaaccttctgcagggttaaagggagaagtctttaaacccatataccaactgtgcttcagttcttttanttttgcctgggtaaactgctgtagggtcagaattaccctttctgtgccaattganaatgaacctgtgtggtactgatgtcagaggacaaactntntgaanggcttgaacanacttga

SEQ ID NO: 4265 - DNA, 793 bp, Homo sapiens
  misc_feature (1)...(793): n = A,T,C or G
ncntttatcaaancgnttgggctactcgntctttctgcaggatcccatccgattcgaattcggcacgagaaagaaagggctcgtgacagagaaagatnnaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacacttgaatcgaangaaagtgatactaagaatgaggtcaatgggaccagttgaagacattaaatctgaaggtgacactcagtncaattaaaactgatctgattnagacctcagatcagacagaggactactggttcgaagatttttggaanaatnctgangaacgggataaagtgaagatcgnncntttaaaaaaatgaggttgaaaagaaagctatnagtggcattnaaaaagtnttaagctncanttagttttntttattattattattatttaaaaggttaatttcaaggacttgatgttgacctccngatttccngaacatgtgttnaatagttnttattccccttgg

SEQ ID NO: 4266 - DNA, 811 bp, Homo sapiens; identical to SEQ ID NO: 3040
  misc_feature (1)...(811): n = A,T,C or G

SEQ ID NO: 4267 - DNA, 469 bp, Homo sapiens
  misc_feature (1)...(469): n = A,T,C or G
ntnccntttnnantacanatacaagctacttgttctttttgcaggatcccatcgattcgccatgcccagctgtaatttcttattaggtgccagacattatgaattttaccttactgggtgttgggtacatttggatgtctttaagtattcctgagaattattctcaggtgcagttaggttacttatgaatagtctaattctttagagtcttgctttcaagctctcttagggcaggagcagcctttagtttatgactaatatggccctggtactgagacactaccattctaagtacctaaatacccaatgccctgtgtagcatgaggcatttcactctggctgataggactgtgaactagcctcaaccttatatggtctttgatgattgttttgcctgttcccttctgtggttcttttcccgtgtcttccttactcacgcttactgctcagtactcagcccgaagactct

SEQ ID NO: 4268 - DNA, 463 bp, Homo sapiens
  misc_feature (1)...(463): n = A,T,C or G
cgttacttcgatcaagctcttgttctttttgcaggatcccatcgattcgaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttctgaattaatctgaaatgtcaagccctggatttgctacagagtgagaagttattttatttttttttatttttaattntggaaattctgcagaaatcanaactcttaccatggtttgaacaaaaaaaggggaaatggggaggggaaaagggtgggattgtccancatgcttgtatgtatatttca

SEQ ID NO: 4269 - DNA, 468 bp, Homo sapiens
  misc_feature (1)...(468): n = A,T,C or G
tccgtntgantaccgttacangctacttgttctttttgcaggatcccatcgattcgaattcggcacagaagaccaagcgcatgcgaacctctttcaagcatcaccagctccggaccatgaaatcctactttgccatcaaccacaacccggatgccaaggacctcaagcagcttgcccagaaaacaggtctgccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaagagagagagagagacttaaatgtcatttactgaatgttaacgaaacttgtgttctttatggtgtctaacacaactgaaggcctaaaattatgtg

SEQ ID NO: 4270 - DNA, 765 bp, Homo sapiens
  misc_feature (1)...(765): n = A,T,C or G
nncttactnaaaccgtttggctacttgttctttttgcaggatcccatcgattcgaattcggcacgaggacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgactgatcctgaaagaggacaaactacattgcctttcagacctgtgactcaagaagaagatgatgccaaaggtgatttgtacttaacatgccttgtcctgatgttgaaggatttgtgaaagggaaaaaaaattctngactcttgatataataaaatgagactggaggcattctgaaattgaaaaaaaaaaaaaaaat

SEQ ID NO: 4271 - DNA, 466 bp, Homo sapiens
  misc_feature (1)...(466): n = A,T,C or G
nnccnnttnantanagatacaagctacttgttctttttgcaggatcccatcgattcgcttggggccaggatcctggagtccttgcttggggataacttcctggagagctgctcagtcagctatacccttgggagtcttttgttgagggagaaataaatgtcattttgcaaagccactgatattctgtggttatcacggcagtttagagaggaaggatgggggaaagctgggttgcgctctagccttgacacttcctgcctttgtagtgttaggcaaacatggcaaccccagaaaactcanctgcctcagttttaaggcatgcagggtctttgtgaggaccatataagccacgtggaggggtctagaccaagcatagtgcttggaagaaagggcgtgtgtgctaatgatttatgtctcttttctttctgagagtcttgctccccaacaccanaggtgagaccacctg

SEQ ID NO: 4272 - DNA, 465 bp, Homo sapiens
  misc_feature (1)...(465): n = A,T,C or G
ttcnctttnatatagatacagctacttgttctttttgcaggatcccatcgattcgaattcggcacgagctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatctaagtaaaagcccactaattcattatgcagaaaaaaatgatttttttgagacggggtctcgctctgttgccaggctggagtgctgtggcacaaccatagctcactgcagcctccacctccctggttcaagcgatcttcccacctcagcctcccgagtagttgagaccacagtgcccttggtgtggtggaagcaaggtgccatgtgataagt

SEQ ID NO: 4273 - DNA, 630 bp, Homo sapiens
  misc_feature (1)...(630): n = A,T,C or G
nnnnactntntcnncatnnncngancnnnnntctcgngacantttgnnnaacngntntgtggggnnngnnnnanntnngcnnnnnnnnnnnnnnncnaanccttggaaacctncctnngccgatccnnnnntgcannatnccgcnggngggactngnaancnngnccanataatnagggnttnnnctgnacnnggcaaaaaccccannattaggnanggngcgctaggnggcccnananccatgnagtggcacgncgncanncngttgtttnnccaatcnnnaattcgnatcgcctcggnancgcccctggggtangggnacactctgncnantggnccnactgntnanaanaagggancnagtgtcnngangnccncggcntacncnagngaatcctnccngngnnccgggngactaggggnggatncnnncangaaggnnnggagccgnagaacanacntgggtgacnggntgngacaaagnnnccgtcnnaaaaatgctangggnaannacanaaggagnntcnaantgcatnannangtgangttccaacgcccnatgaaaaagggannanggaaagtcgcacantgattganangggncgccngnngngcatatnnaaatnnanc

SEQ ID NO: 4274 - DNA, 618 bp, Homo sapiens
  misc_feature (1)...(618): n = A,T,C or G
tnnncnncanncnnnccnctnnnncnnntngantnnnnnnnnnnnacntnctcangnnngtnncatncannaagnnngtantntngtcgcntgnncntnnnncnnntatcgnaatnnnnnnnnnnnntncttncctttggtaaccccttttnnnccntggcntnacncatgnaacccgtaagncggngcnangcnatagctatnaacgaacatttnncntngctacggnnnattgnactnacgcngncntgtangangccacnttnacatgcnaggncggcacaccggtgnaataatngngtcgctnnntgggtgcggccctaacgcttccnttngcntnagcncangngcctnagactnttacagnngcattgganaangncgcggcgtnacccgctgcnntacncaatnaaggngtgtgaaacacnggacntgggttgaaaaacnntnaanccngatggcngagcntaagccccgngggngcctgaggaagcgtgcagcnaggtncnnatganaaatcacttgtgncnaaacggacaatganctgcgnagnggaantctgngcncgttaggncacncanntgtnnattgggcgcattgaanngncatgactccnnc

SEQ ID NO: 4275 - DNA, 1446 bp, Homo sapiens
  misc_feature (1)...(1446): n = A,T,C or G
gnngngnanngggnggggnannggngaggngngngnggnngnggnggngngngngangggnnngccnnannnggccggagcnggggnnncggngngagagngcnngnaaagccctttggaaaggncggagnngagtggngggccgncggagaggggggnnggggangnggggnagngggnggggggggngnngcncgnntgagnggnnggggngagaggggngcnnnnnggnngggggggggcngcngggggngngagggnnggnnggnagnggngnnngaaggnggnggncgangnnnnagtggangncgngagngcgggggaanggagnngcgnggggnngnngggggggnngnggggagggnnaggagggnnagagngncnngtggnagggagncnggnnnnggaangagcgaccnggaggggaanggnagggannggggngagggagaggnnggnnagncgnagagagggncngggnggannacggannacgggngcnangncntngaggcnnccnnggggaggccnannanggtccggggggnncaggaagganncaagggaatnaggaaaanaagncgccaaggggnnggnaagnngaaannnngcanggggggganngccgggagcggannnggnngagnganagggnanggngggangaangcgggnnngggggaaggagnggagnganaaaangggccagggagggnggagangngnngaccnnnggnanancaangggngaaangcnggangggggnagagaggngggannaaccngaganggaaanggggangggggccaaaggggggggggagccccngggngggaaaaggganccagnttaagaaaagagccgggnnagaggggnngggaanccaanngtgngagagggcgnccgaagatggngagannaaaccaggggganagcatgggggatnanaggganaacccganganggaaaggcaaggggaacncnggganngggggaancgnaagccgggggnggcngggnnaangggaanagnngngagggggggaaggggaanantgaaccnngggnaggaaaaaacgggggggaantnaaaaaaggggggggaaaaggaaantgcgggagccaangnntgaaagaaaaanaaatagggnaagggggggggggaganaggggnaaaaagggcctgacatagaggnggggggcgagtatgggnnaaagaaaaagggggngntnnaaaagggncncngngaggtangaggggagggngggtngggaganagngaanagaagagcgaagagatnagtnnnaaaaaangggngganaaanntgcgcaggggaagctggggaaaggggnggggaccccannagccncgggaanatgtgncngggaaaanaagggggggggngnnaaganagggggaaaanaaaagggcccaccnggg

SEQ ID NO: 4276 - DNA, 762 bp, Homo sapiens
  misc_feature (1)...(762): n = A,T,C or G
ggtggttttnangnnnntttttctantngcagctacttgttctttttgcaggatcccatcgattcggntggctctcccagcgtctgacctggcgtgtctctcagtcccatcccaaggcgatgttctctaccgctagatggagcatcagacctcaagtcaagancatcccagttcactgntgcttnnggtggctctantctgggaggganggggagacttgaaaatgggangatctcattggcttgctaaggnttnggatttacctcntatcactggagacccattgtagcgacaangtcaagggaacnngaacttgtttactatcngtgcgctctacattgaatttaccgacaaactctgtgannaatcngatatgaacaatgcacnctnnnctngtctnagacannnnnttannaagaaggngcacactgaacnnnctnacagcactnttngntaggggcactgtactntgacctgnatgaaantntanccgaggccanaatngaccnactatnaagcttaacacngattnnagnnatataatnaatgannattnaanatgancctganctannagcttaatagtnctgatgggcctncatgtnatntcaaaggnctttgaattggctacttanaagganaatggccaatngnacgtgttnnangaaagggaaacaggaaangcncctagtcccantgtaatgngtcntnggcaancaanctgtttaaaacggtntcgnaaaaaaanannttccnnnntnn

SEQ ID NO: 4277 - DNA, 793 bp, Homo sapiens; identical to SEQ ID NO: 4265
  misc_feature (1)...(793): n = A,T,C or G

SEQ ID NO: 4278 - DNA, 903 bp, Homo sapiens
  misc_feature (1)...(903): n = A,T,C or G
ggtttntttntttgnngnttttgngcnttttnaggcgtnntntctgatccccgctaattgcattcggncgngctnccctacagatantgcatgcacnttgnagntaattcagtgttnttaacngntncatantntatcaagcngtncatgaangtgtngtnatnaaatgtctatgtatctntagttacattcaaatnngnaactttataaacatgttntatgcttgaggaaatttctaaggtggtagtataaatggaaactttttgaagtagaccggatatgggctacttgtgactagacttttaaactttgctctttcangcagaagcctggtttctgggagaacactgcacagcgatttctttcccaggatttcacaacttttnaagggaagatnaatgaacatcnnatttctaggtatngaactatgttattgaaaggaaaaggaacactggtgtttgtttcttagactcatgaaanttaataattatgaangcaatgaaaaattaanttgaaacattaaantctncntgacantnggaatnattcctttgccactttnttgcattaatttcagaanacnattccgtnnnttnttccantntngcnaacccatttntncctggatnttgngccatanttttgacntcccggntntnattcannatnnccttnncccggtaatcgnncantttggganatctgnnantnttaaaatatgncntttatatatanttaatttctttcannnaaanttctggnataggcctggtnatttanantnnnttnttatttgnnggnanancnntttatcgtntanaanatttaaccncttnntnttttctgnngcccttttcgtataaaaaccttcntntatntttnnngacaatnttntntttnnnc

SEQ ID NO: 4279 - DNA, 866 bp, Homo sapiens
  misc_feature (1)...(866): n = A,T,C or G
angcnagagcccacggaatttncatgcctttatcgagncngcncccgcgcggannnaaacagcnggacntgccncacgagnggantntgcncttttttttgggccgnccanntcccacagncnganggggggttaatnncngaacgctgnagaatanntattgatgagcancngagaagnaacatgnncatggccaccaggcncgnccactcacngcaaaagtgaccaagccagcangtcacccttaactggcagaaaccaanatcagggnggnagnccggacttnaaatgcnnagaaacctgtnagtgatggaaggnnaagaaaaattcagnatgganaanaanaatcngggcacncaaacaaattcactganaantccanaagnctattnanaaacaagatagcnatgagtncanatcnatccnantggncntntaatnntacaaccaanccttaaccttccactctaaagggaaggaatactangaatggattacntttccggggtannataaancnggggnantaaatgatnangggaaancccaaaanctacccnnnantcnanggantntggaatnccttactcttcatcaagancatttccagnttctaaggggacccctttacnaanttnaaaanggattcnannttggcntctnaagngggntcgcccggccccnaaaaatnatnataatggaccnggggntcaaangnanctnacnggaaaaangaaagcccggnaaaggaccaggcntttccaaggaangaagggaaaatncccncgaaancccccggaataaanctcaanggggttacacaaaaaagccatccccncgaattaancccaaaaaattgggcagcc

SEQ ID NO: 4280 - DNA, 750 bp, Homo sapiens
  misc_feature (1)...(750): n = A,T,C or G
gaancactcntnatcgnttgcaggatccctcgattcgaattcggcacgaggctgggactgacagcctgcagggtttccttgggcgcggccccaaaattgccttcaaaacaaacccgggacggttgaaagccttcgaaccgtgcangggatgcctcgggccctggcccttcgcttcctctcttgtgttatggaaataaaaacaaataaaactacaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcncgcttggcgtaatcatggcatagctgtttcctgtgtgaaattgntatccgctcacaatttacacaacatacgagcccgggagcataaagtgtaaaagcctggggtgcctaatgaagtgagctaactcacattaattgcgttgcgcttaattggccgcttttccaatcggggaaacctgtcnangccanctgnattaatgaatcggncaaccg

SEQ ID NO: 4281 - DNA, 1094 bp, Homo sapiens
  misc_feature (1)...(1094): n = A,T,C or G
cctntnnncnantanantacananntnnttcacncncantntaatantntcctntctanctctcttanantttacgcnnacatatncncnnnnctnatcttctncanattttananatatacctnannctccatncannaggtngtnacnnnggataaatnggggngntngtaangagngctnatcnaactactaggttggaatnaattcctnccnttnttctnactnagntnaatcatcgtacgaggaaaaaacaaagnantancttangccttngacaaggatatnagcacctaatgtactnntaagcttaacctggnggnaancccnnatanncgtaaantganantannnaatgccacangtgnagntntgcatcccctgaaannctnanaacaaatgnntaangantatgnctgtcttaantattctttcacttanttagttcnactgcanacccccatcctgnnaggggttattcggnagttaaggtactttcataagttntaaacanaatgatatntgntattacgntaacctttctcttgatgacaatganaaananaagccagtttccacagaagactananaannannngttnggggtgntcctnctggnngntatcnnttnttgccanacttttcccnncattttaaaanngtnnaacanttnggatcntttcattntnnctttcggtaaannttttaatcntcntnacnaattggaancanatatttnncccaantnnncctttaaaaatcttttagccaacancttcttctannnaaantngnaanaaccctntnnnatactaatgaaannntgnctattatnctnacnttgtttaaaanaatcntattcttngnganacccnanttattcnggtttcnccccctttnncttnncnanangcntcntnaantgnncacaatancggtctaaanctgngnatncacannttcaccttacccttacntantnantntncttgananantaantaggntcctcttagcctcaaatnaaaataactttnnnaacntntatanctntgcaaacntntttnccanncntnaatatccaatttncncg

SEQ ID NO: 4282 - DNA, 1247 bp, Homo sapiens
  misc_feature (1)...(1247): n = A,T,C or G
nnggatnncncgcgtcnncgcnatgtgcnannaacacnantgtgtgntggngcnctngtnttttacngntgatnacnnagatnttnttnctcccnggngacgattgnaatcctanacagactacttgttgctntttgcaggtacccatcgattcgaatncggcacggaggcnancannnntngggacnnggnttaantggcgncgnnnntnnnnacnanagggnacgnanannnttcntaacaccttnnnangttaatnnactntgcagcnntannnnctccntaanngnnngtancngnnntnaggntnnnngcagtnacnaantangctacagnnnacgntnaaatnnttngnnnnnnnaaaantganggagncaaatagtgntngntgnanncgttnaanatnnggncagatnggtcatnnggnnnntnnttnatntggnaacntanttngnnantnntgngtnnagcatnngnnagnatnntnatatntntaactgntntgaccaaatncatnaacnnaattactgnanganaancngccnntnttntnnntatngntancnaganngtgagggcgnngnagtgangatgtgtagaannagntnngaagtnatgcnacacgtttatatgtnncntntatcagnggaananngatntntanngnttgacngnnntnnngctaaaganaanaggnnnagcgaganngnagnnntctgtacagantcccncnaantgtnngnccgncgaanaatcnatataattcnntatggttatcnntgtaggggcgttcnacacgatnaattatactnacgattcgtangttncttacncaatancgcncgctgnnanannnntcnanntcgcgaaactatagtancnncgnnagggnaaagatncanngngtacgcaattaaanacnangcantnnntgnngganatgtacgtaaccatantgnntacntactannntacatgngntntatnttntgncgatgatatcgtanantatatagtncgantgatntatnatnctctactnataganttgtatntnnacanaagatnaatatctacatntantancanagatangctgcaaatnactggngnacacntcatanataanaccnncaanantgcgannnatcatnatagagtgactntattatannaaaaataaccantncgtganatngannntnaatntacgtggttngatgatcgctacgtanaaccncngnncn

SEQ ID NO: 4283 - DNA, 847 bp, Homo sapiens
  misc_feature (1)...(847): n = A,T,C or G
cctgctgtngggnanatanancgtgctcnntttgtacttccccgnatgnnccatcnacncgacgagcctaacgcttgtcaactngngggatcnganttngagantgactttgtgncatncntgantananctgtangttngtgaaanccanactacnnngcctcngnctcatcacctcttacacattccnnanantnncncagtctnnanaangagncntngatnannaanaagagnctntgnannaacaggnntnnnaagcnngnnnnnactnanagcntgngaantgancgnnnncttggtctgngtccggtaagaagacancantngcncanngacnggnnanncgncaggccantnaangnagcntgcgntnannttnnatgaagttgagnatggtnaacnnaatntcnaacngnnctntgtncntgnnngnnacacntgcctganaancntananancnngnantagantncnnnaacncngatcttatanncactttggaanaagcactnatcncctnacngggcatcctntttgagancaggacanctgttgnngggacgccccatgacacnggcccagaanactccgggttntttgnntttcagcnnnaaanggcgaagtgatttcctnttncntncngngnacncatnggctcatgnnccccctnaaanntnnttanngnncntcgntanacaccctnnatngcnaanggcccaangntncnanttcgcnaccntttaccatnaaggatattaccnnaaccgtgccctttngantngccagncnattggnnntttnnttgnaccatttnggnaaaggggcaaantntttanncgtcnc

SEQ ID NO: 4284 - DNA, 761 bp, Homo sapiens
  misc_feature (1)...(761): n = A,T,C or G
gncntttganttcatatacaagctacttgttctttttgcaggatcccatcgattcgctgcagcgtctggngtttncnttgcagncctcggaaccagnacctcngcgtggcctacagagttatggcgacaanaggccgtgtgcgtgctgaatggcgacggcccagtgcagggcatgatcnatttncagcngaaaganantaatggaccagnnaacgtgtggggangcattnaaggactgactgaangcctgcatggattccatgttcatgantttngagataatacatgaggctgtaccantgcaggncctcactttantcctctatccanaaaacanngtgggccaanggatgaanagaggcntgttgganacttggncaatgtgactgctgacaaaagatggtgtggncnnatgtgtctattgaagattctgtgatctnactctnagnagaccatttgcntcattggcccgtacactgttggtccatganaaaagcacatgacttgggcaaaggtggaaatgaagaangtacatngacaggaaacgctgnaatgatttggcttgtngtgtaattggnatccccnaataaacatcccttggatgaagcttgaggccctttaattcattttttnantccngnnaccttgttaantggnacntggaacacttaaccccttnntttnntaaaaggagaaanngtnttntntttnanangagttttttaanccccttggtcganaaaanttnntttttnatttnt

SEQ ID NO: 4285 - DNA, 805 bp, Homo sapiens
  misc_feature (1)...(805): n = A,T,C or G
tnnctaatannanaatnctncttnttgntctntttgcaggatcccatcgattcganntncngangaggagannctgtcggncatgtggtggaancnggntncggacntgncatngncntgtgccntgtnaactacaggcactgncnntttggaacaactcanggcattcatgcaaggctcatncctgtggnannaanngggactaacattattggtgcggctnccnaagcatggtntcntnatggatgnattctgtccctgtgncnntgatannntatnaannnactgaagatnncnatnaagttaaatntaaagagnatggcntatnaacngatcaggtangganntacnntggcaacncgagacactgtnngtncaagagcgcnntgnggcntgctcaataactngngccacaggcnacacnataatntactctatanatgcnctcaatacnccggtnacnntnnnnaggacngntcattattangcnctcctggactgnaccgnacttgtctctgnacagngatnnnccncgtnccttanaaagnagttcctacnaaacntgntangcattatanangtatgcctgcattngaactgnacgtctntgagactntcaataacgtggtncanttgnnattncaagccacntatttgagngataacnntggcgantgatcatncttactnggcccttaatgttcncannttgcantnagctngccntccangaaaacctngttttcccggttggganataaaaacngggancctggaatgcaatggnaaaaanccgnttagaann

SEQ ID NO: 4286 - DNA, 805 bp, Homo sapiens; identical to SEQ ID NO: 4285
  misc_feature (1)...(805): n = A,T,C or G

SEQ ID NO: 4287 - DNA, 746 bp, Homo sapiens
  misc_feature (1)...(746): n = A,T,C or G
gnccnttttgaattcanatacaagctacttgttctttttgcaggatcccatcgattcgctgcagcgtctggggtttccgttgcagtcctcggaaccaggacctcggcgtggcctatcgagttatggcgacnaaggccgtgtgcgtgctgaagggcgacggcccagtgcanggcatcatcaatttcgagcanaaggaaagtaatggaccagtgaaggtgtggggaagcattaaaggactgactgaaggcctgcatggattccatgttcatgagtttggagataatacagcaggctgtaccagtgcangtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcanatnacttgtgcanaggtggaaatgaagaaagttcaaagacagganacgctggaagtcgnttggctngaggtgtaattgggatcgnccaatnaacattcccttggatgtagtctgagccccttactcatctggtatcctgctagctgcagaaatgtatcctgataacnttaacactgcatcttaaaagtgtaattgagtgacttttcanagtgctttaaagtacctgtagagagaactgattatgatcactt

SEQ ID NO: 4288 - DNA, 762 bp, Homo sapiens
  misc_feature (1)...(762): n = A,T,C or G
nnatatnanggnnnctnnttacttgctctntctgcaggatcccatcgattcgagaccaacccgcctgcaggaggctctgaacctcttcaagagcntctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttccccgagtgattttgcgaaacccccttttcccttcagcttgcttagtgttccaaatttagaaagcttaaggcggcctacagaaaaaggaaaaaaggccacaaaagtnccttttactttcagtaaaaataaattaaacagcagcagcaaccaattaaaatggaattnangaaccaatgaaataatnttgng

SEQ ID NO: 4289 - DNA, 1563 bp, Homo sapiens
  misc_feature (1)...(1563): n = A,T,C or G
gngaannaaaggaacgaccggnaaaaangnnaccgcggcgnncacngacngnnaatacnnngcgacggnncgtgnaaaagnggngaggcgnaagtgggcnnaaataaanaaaacgcggcgagagcancngnngaactanntngcagaagagatggtnnangcacggagnggnccgtttttgaaaaccncctcggtncaangccccncgganaaatngtacgcgtgngtaagaaaggccngnnaccgtgnaaantcgtgccgnntggagcgagcgnagaaaanncaagtgcnaagacgacgaantttttgtgncncnagtgngaanannaggtggcnnacgngggngggggggggntngnagangngaatngtnagngnangntaaaanacncgcgngnnggacacaaaagangganancnnatgnggnnagagaantnnggtaancgnngnnaggagaagcgnnngnanaggngnaggtatngnangagcgnancannggatncgagggaaaagcggngcgagaaacatnnntnacgacaatggngcgagaggaaacgnngcngcggaannnnaaannaantagagaganacnngnagntggnananaaangngggnggaggaannggnnnnganggagatagagncacggggcgtgananacaaacagaaagtgacgtgnnatagangnncgnaacntgnangangnggcatannnngggananagataanntccnagatagagacgacggggcgcntanngnnnnagattgncggacaancgctgatgcgtncnnangntgagagaaagcgangncanctcaggggggggaagggnngtgtagngagcgnacncaaatggagaaagaacggtggaagacaacgacgcggngnacacacgntngagacgtgggcaaacanagcncangntnantngagtgngncgatgtaagtgacntgaaacatacnanctcggnnggagggnataanaanaggaatgngnggnangcgaaganaagnntntncgtaaanaactaganggncgcanaannnggngaggcgaagacgatgannnanganaaaggnggatcnaacggannnncgnatgcnattntggcncacngtaatatatggannagcgaggacatnggcgnnngagaangccggaangacggaagatagaatgnaanattgnggggagngnnagnaatgaacgnnnangacgngcaggtttgngagnggagnangaaggggagggacgacgagggtngtagnggagnnggacgagtgancgcngagtgagatncaaggacgaagananacnnnggnganncgtagntcgcgataacgnnataangagnnanagngganncanataccgaanncnaganncacgtgnnganntgcaaaaaaagaancgggntnggcangacgatgcggnnngagaaggganaaatnacncagggaanntgggnngaacnncaatangngtncnangcggaaaaangngngataaggnaanganggatagcnancgggngacnanngtnncnagngaagccg

SEQ ID NO: 4290 - DNA, 752 bp, Homo sapiens
  misc_feature (1)...(752): n = A,T,C or G
gaagtngctcttgttctttttgcaggatccctcgattcgctnacgtgtcgncggggcggtcgcagacttcagggtnctctaacggagaggccaggcnccgcgtggccngacaactncctgnccgctccttcagcaagtgactgtctntnncactncttacctgctgaangatctngctcagcngctggaacaatgctgctgtnacacantctcnnctntgcnacttnaggatgctncttggtcaccaggnantggganctgtagaccngncgcatgcacttncncnacattcactgctgactggcttanctgnnatangttcnagngaccgggacttntcttanagtcagnagccctcncaactacntcataccntcgcatctgannattttcacagaggnnttntcttngaagnngacttggcaagncttacaagttgatnnatngnnattggnaantncntttcttcaaatgctaaaantcatgtcctcataaatgcaantgattttagancacaanntccccatgtacannttccattanttaaactagaccaatgtgtacgggtcatttgnngtattgnggaacatcnnngttactggaaangactattaanatttcacagatgggcttnatcaanttgctangaattgngtctnctaagtgtagttaacttgcagaatccaacttaactncnagnnnaantttcaaaactgatnctgtgaatggatggggancatcttaactnttng

SEQ ID NO: 4291 - DNA, 881 bp, Homo sapiens
  misc_feature (1)...(881): n = A,T,C or G
annnnnnnnnnnnnnngnnnnnnnnngggnnnnnggnnnngnnnnnnannnnggnnnnnnnngggnnnnnnnnnnnggnnnnggngncngatangnagacccgttnatacaacgacccacggancgganncggcacgagaagcngcnagggccaggngnnaannnnanaggnnnagnnggacncngnnangaaaaganaggnnaggggngggcgacaggnnganacagncnnagaaaaagcaggnannagcaaagnangggaaagcnagcgggcangcncgcnaaccnggggaacgnccccnnnaacacnnncnaaacncgngagccnccnnnaacgaaggaggaggaggagcaaaccnnnnccngggacgganncagnaagagggccagcgcccangganaancacaagnanganagcnggaacnggcncaaanacngcagcaaagncagcanaganacgcaaaggnacaaagannnngagccaggcannagncnagacacagnaagggaacagacaganaggcanncgaggccnggaaggagcgnacaanccgngnggnnnnaaagcnaaangnannaaacangagccanncngagggangacagccagnannaaacanaaaggccgcacgnacacagcagcgnngcnaagcgggaggagccnaaaanaacanangnacggnnggcccggcnacagnggccacgncnncgggggnccnggcncccaaggggagggccnaagggggngggnnngaacnncccgnggggacnanaagnggggncncnccagnccggggnnaacccgggngggaaaccccanccncggagngnaaaaagggcccaaaanngcccagnaggaaangnngcnggggcaaaacng

SEQ ID NO: 4292 - DNA, 786 bp, Homo sapiens
  misc_feature (1)...(786): n = A,T,C or G
aangnnngngggnntgntttnntggntgggntgttattcntggcgctctggctacttgntnnatttgnatgnatncgggcgntncgannngntgtnctgngttnnatcttntaaatngcttgtccttattatgttgttgnttaacancttaaacgctanctctagaccaggaataattatttgctatatattacagcaaaaaatatgtatgtntaaatggactcattcaagaatatataagngaactcctattacaaagaaattgncaaacagcccagtatatnaatgaatataaaaatttgagaagatattttncatngnaagatntcnaantgaacattnggcatgnnaaaaccaaattttaggatatnactacacactctggnctagtttaaaagactganaatattaagtgtgtggnaatgtnnancaantggaaatggcctgcatntngcatngaaatgtaaaacantacatatactntgcaaaactctgtccaacattntctacccattnaccaagcaactncatcncctagctatanatacccagggaaaataagtanggtatcttcacagaaatnattgtatgaagaaatattcatagttacttattgcacntgtcagttatcangtnaanctgtctcncatcnggaaaaatgggatatcaaaattggtgtggataatnaatacaancaattagggatattacttggngcnaaacaaaaaatgaanacanggggaaaatncacattcaaaccaaantangtggcatattatacccacg

SEQ ID NO: 4293 - DNA, 866 bp, Homo sapiens; identical to SEQ ID NO: 4279
  misc_feature (1)...(866): n = A,T,C or G

SEQ ID NO: 4294 - DNA, 787 bp, Homo sapiens
  misc_feature (1)...(787): n = A,T,C or G
ggnnnnnnnncnggnttnnnnnnttgcttctnagccttngcatttgactcctgcaggatcccatcgattcgaattcggcacgagctttagttcagataaaggaaacatccaaaaatactgagatgagtaaaattttattcaaagtaggttcctgctttgtcttgatctcaatccattctaactcctgatgtcatttaccgtgtgagatcttagtacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttgaataaagaagccctcttctattttcattcttaatgaatataccttttcccatgtccacattgagcctcccttctgtgtactctgctaatgcagccacatgtctagttccccctctctgcaccaccctcacttcttctttcccatcttcttacttctttggtgtgacctctctgtaggacaacatgccatttctgattccccacacacataccctatcattgatacctaccctcanggattagaatctggctagtaatttggaagagcccatcaaggctttagtaaagtattggactggnaagtcaacacccattatctcatcaaaagggatgctgtgttgggggcananggagagagagagagagagaccganagagagacagacngagagagagaaaggaat

SEQ ID NO: 4295 - DNA, 795 bp, Homo sapiens
  misc_feature (1)...(795): n = A,T,C or G
ggnttnnnntnntgccttanaagccttgcntangatgccnttnggatcccatcgattcgaattcggcacgagggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtangctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaanacactgggtttagacattggatattttaaatgattgnggtgttcaattcatgtgctgcccaactggagttatctagtggatattgaccctcactggcttgaccaaaagcccggaatagaaaggcagggaattcctgaaattctaatcttaaaaatttggcaatggaaaaagcccttttnccctaaaattantcccattnttgtaaattccttg

SEQ ID NO: 4296 - DNA, 740 bp, Homo sapiens
  misc_feature (1)...(740): n = A,T,C or G
taagttgctctgttctttttgcaggatccctcgattcgaattcggcacgagactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcanagacgtcaagttggctgangcacaccagcangagtgctgccagaaatttgaacaactttccgaatctgcaaangaagaactgatnaatttcaaacggaaganagtggcagcatttanaaagaatctaattgaaatgtctgaactggaaataaaacatgccangaacaatgtctcccttttgcagactgtattgacttgttcaagaatactgatatgccttcctcagaagaaaagaaatgaatgtgaaagaaagccagcctcactgccttaaatcattacccggaa

SEQ ID NO: 4297 - DNA, 1191 bp, Homo sapiens
  misc_feature (1)...(1191): n = A,T,C or G
cccgcatataaanananacccngngnacnaannacacacccannaananataatanngcnataagnnnacangggggaacaggggantanggncgaatgangacnncaattnacaggnatttaattccaanncnntnanactacngncccnnanatcnnacgagnatncancccaagnagnancngacantcagangagcgtnntacaannacngcaannacnngaccagncnggancgataangggggncaaancannanttccanggatcangcatagtacnaccnctgaatnggtaccattncnactttacncnngacnaacaagtatccctgntggcctnaaaatncaagttgaaaatnaantcngaantctnccagancaaanangacatncannccnatnnnttanantacnaantatcnaatgntanaaatccatggnnaagacataaaaactnncagctatanaaananctnntaaanggctattnggatntaaaaaccanatnatnnnaccntncaacnacctannnntnaagaaancanntnnncaanaantacnanccaatnnncaganggacgnnaaatgnnnacantcangaaattgaaaccnganaagncccnatnnaangnnttaaaaacntcagcggcaaatcccncatnccacnaanggnntnncggaaaanggnnnntaactggntaacnccnatantntaaaacgggaaccatcgccaatgcgtncgctanccaacananntaaancgatcnacannaccacagnnncntattnaagaatctngananncacacttacnnattcaaataggngncntnnnntgnatatntancnnatnngccacatctnatntatcaccncannctcanngntcnnacancatggagagcatntcgnganacaancgngtgannancacatcncancanngcgaaacnccanatatntacntgggtantcancgcgnaactgcgcgcgcgnagnatnagatcacattatntgatactacagctaaanngacacacattacanngtntntacanaaatactntacnntcnanacncnntacacacaaaaattacctcanagggagananntacatatctnaaaacanccccnanantnancnnaaaagactccntacgcgnananagtgcgctctcgnaanng

SEQ ID NO: 4298 - DNA, 753 bp, Homo sapiens
  misc_feature (1)...(753): n = A,T,C or G
ntncgtttnnntanaacnttgntctttnantctgcaggatccctcgattcgctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctgccttgaaagaaccgaagtctttcccattcacttctctagaaagctgccaaggacagaggcagaaagaatggatgaaanttctgtcaagcacacttctggtctcttaaaacttagaagtggttctaanagaacagaagtattagagaaacagttcctgtggaatcacatctttgggtggnacccattgctttttttctggttga

SEQ ID NO: 4299 - DNA, 753 bp, Homo sapiens; identical to SEQ ID NO: 4298
  misc_feature (1)...(753): n = A,T,C or G

SEQ ID NO: 4300 - DNA, 850 bp, Homo sapiens
  misc_feature (1)...(850): n = A,T,C or G
gctnntgaccannntanngntnggaatcncantcgctnnatngcncntngattcgaattcggcacntgnngtctnnctgntctgtgttggcaagggttagttnccaagtgagcaagatngttccctnctaacaggctccgacgggtgaacagtntgngtgntatccatacncaggcacatgccatcggcttacagcanggtcctcaactggtgcctgctggccctgggggangaggcaaagctgtggctcccagcaaagcagancaaaaagagttcgcccatggatcgaacantgacnagtatcngcnacgccgagagaggaacatcatggctgngaaaaagagccggttgaaaagcaagcangaaagctcaagacacactgcaagagtcaatcagctcanaagaagataatgaacggttggaagcaaaaatcaaattgcntgaccaaggaattaaatgtnctcaaangatttgnttcttgagcatgcacacaatcttgcagacaacgtncagtccattancacttgaaaaatttcgacaagcagatgggngncaatggcacggaccanttgacccttaaccccttttccaagacttttanaagcttgnaggctttggaatggctaaaanggtggtggaccccccggnaacctcnntcattgtcancngggcntnaaaaantttggcccatttntcccnttgaacttcannagnaccccatttggtaggcctatttttcctgggggannnaaatccctncaataanttntnnnttnnncnttaaaanngnttnnccnttnngnattccgnattatccngggnttttaaaanggatnananggntttttct

SEQ ID NO: 4301 - DNA, 790 bp, Homo sapiens
  misc_feature (1)...(790): n = A,T,C or G
cnatcatctttgnttctatactcagcttgcntgtanagnangtccgggttaccgnncnccanngtaccctatanngantngtantacaaagagactnanngcnnttnaanggccgcgttactacanannacnnantngtnacncnctngnatcaccnancttaatctccttgtancacatncctncttttgccagctngcntgatngcgaagaggnccctaccnatcgcncttncaaacagatgnggcaaactgaatggcaaatggacncgccctgaacccncgcatnaagcgctgttgctgtgcaggttacccgcncagtnacccantacacttnccancgccctagcnccctttccttcctttctttttcnttacgtacnccnnatntgcgnnggatnntnnnantaagctntnaattttaggcttccnatacngtncntaantagngctttaccgcacntngatcnntnaaaantngnntanggtnangggtcanataccgtgccatacccttgtagaccnttnnttnccnttgaacgtngaagtanatcgttcnttaataatncactcttgganccaaactggaaccananctcgacccaatctncnggntatntnttnggatttataaagngattantgccctttgtnnnaactattggggcttganatntgnccaanattttaacgatgaaattttaaaccgcgaaattttaacncaaaaaattttaccgctttancaatgttatttggaatgcctntaaaccccctttntanntcnctccccc

SEQ ID NO: 4302 - DNA, 775 bp, Homo sapiens
  misc_feature (1)...(775): n = A,T,C or G
catatatctttgattccnttnaacccttncnaactacttgttctttttgcaggatcccatcgattcgaattcggcacgagccaacgatctgtatcaaccacgtcttcattttccttttcctgtttgncttactctccccccaaaaagagtcagtttcctgttttctcaatttctcagtttaaaattagagccctatggcaggtgccatgtacagctgcaaaggtggcaagaagccctgagaaagctcaagaacaggtcaagggggtgggtaaggaagatgggacgttcaagcagaaacaaaaagaggagctaaaagtgaaagccaccccgccaccagccctcaccagtcacaggtggaattaaagaaatctggcaaaaaataaattttgttatccgtgcttggggcggtgacccttgaccccattcctatttaaacatctggattctctgccataacatcttttgccacctatagctacaataaagtgtcgtcttggagtctgttgtacatttaacaataaactttttgtnaggaaagtaaaaaanantctacagttcaatgcaggatanggatgggtgggccttaattcaggaggtgggaggctcaaaatcaattactctgtttgangagatggaatctnctggaatctcaaaaanggatttncttttangaatcatcaagactcatcccgacttcgtcaagtcttttctcttgttgggagttatggttttggnttttaattttngttttggtttttttttttggggggggnaa

SEQ ID NO: 4303 - DNA, 940 bp, Homo sapiens
  misc_feature (1)...(940): n = A,T,C or G
gtttcatacaagctaactnggttttttttaaaagccccgtttccccaatcggnatttgnggtgcnactgcggggagggagancccntaccngangnacccnaattgcgggccacgggagggcgtanacacttttnacngngtanatggccggagnnggngnttttanccanattttanttnntgggcnccccgngtgctctggtcagncctttaagtggttnaanangcacgngcctancccctaanttaaaatnccccagnanaanactnttgcgcnatnaacatcactgannggtgtttctnatagtatgntntacacctatnacantttccctcaatantnattacctgtagngcaagtggncanacttnanngcagagtnaactncanggngtttctnaatnggnnnatntcggacngtctngtananttgacaacgnaaatatatgacgncnatnggaaaatnattgtngntatgcaaggcnttgcggngtccancntantnctnatgttgaaaatncganttataactnntatgangctgcttgttnnatttganaancntttcctaanntctttganncgcnaattaaananntngttnntganatnganagcntaacacccgctacaanatctagnttgnactnaatgntgaaaactccgaacctctgngaaattcatgtttnattttgatgaacngggcctccaatntnntattcggntttntannnggacgnnacctgttgatanngcttttttcttttncntntnanngaanaatnaacctanntaactcaaangcnctanttgatctcantaaaanncngantgnaantncncattgantttnaaagcgggntttantttaaaanaacntcccttttgggnctgtgggtngttgncnacncnananggtgnaaaattttttttttncg

SEQ ID NO: 4304 - DNA, 881 bp, Homo sapiens; identical to SEQ ID NO: 4291
  misc_feature (1)...(881): n = A,T,C or G

SEQ ID NO: 4305 - DNA, 891 bp, Homo sapiens
  misc_feature (1)...(891): n = A,T,C or G
annatccttctgangttngtctngctctttctgcaggatccctcgattcgtnagtgtctgnntgncaggnccctcaaagattcctnggncttttcccatgtgnttgaagaagaantcnatngncnntcattgaatcaaactggaaaacctgctggcntgctgctgacgactctgnggctancaaggtnctanactcnnaaaacatganggtngtnagancctcnncgagacatnccaatatctgctcctcagtggctttgcngnctcagaggcctcanagcctgctgtcatgtggacctggatatgcaggtgatgctgnggactcttcaaaaagcccnaccactctgngattacgaatntacangacagatganacacgaacatgatgnaaagcccaccatnaccnntanagcncttaaaccctgncctagnncattcnatcnanggggnttcntntngctatattggtagttgcnnngcngacnatggtaaanggacnaatnattcgggtgatgggactgnantgtgancnggnnctngnaattanggggccanncttctaggggngtcccnncncntgcctntcnntccanaaatgcntanacgctgcttntacctgggaagngnatggatgngnaaagaaacnccntnnnttggngnctttgccacacnncnngggnaaacttttgagncannaaaanacccncntataaccanntttnccntccnctaaaaacttgttacncncaacntatnggcaataggnaaaaacccctttacagggnaccgnaaaacctttggcaacnccanaanntntgncgttnggggaaaaaantacctttggcccgntttttttacagnttngacncaaaaantttaaagggaaanccc

SEQ ID NO: 4306 - DNA, 770 bp, Homo sapiens
  misc_feature (1)...(770): n = A,T,C or G
ntcnnnctttaancccntatccttctcnaaacctttggaacgcncnctntctncaggaancctcgctnnagatnctcacctcttnnnggtctngnntngtctgcctacattcccacagcagacaaggttganaatccatngctgnaatcttggtattgatgagttncagtgatggaacatgtgcttggccacaggcaggtccagtcactgcaaaagtgaccaanccancaggtcacccttaacttcagaaacaattattggtggtgaactgtacttaaattgcagagaaacctgtaagtaatggaaggtnaanaaaaattacanaatggaaaatnatattttgggcaagcaaacanattcactgagaattccaaaagtatattaaaaaagaagatagctatgagttcagatctatcttattggtctttaatattacaaccaatccttaactttccactataaangaaggattactanattgattactttctgggtagataatctggtaataaatgatagggaaatcaaaaattacttttatttaggagttngaattcttactctcatcagacattttttttctangggacncttactaattaaatgaatttaaagttgttccttanggngtcnttngcccntantatatttatnactgngttaatgantantggaattntgccggaangacagnttcangaagaggaantcncgaancctgataatctatgggttagaaagcntccctgnatatcnaaaattgccanttt

SEQ ID NO: 4307 - DNA, 732 bp, Homo sapiens
  misc_feature (1)...(732): n = A,T,C or G
ggngggntttttnatatanacangctacttgttctttttgcaggatcccatcgattcgaattcggcacgagggccctcatctccagctaactgtggagaagcccctgggggctccctgattaatggaggcttagctttctggatggcatctagccagaggctggagacaggtgtgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttnacagaggaagaaacctggaaccagagggggcgtgcctgccaagctcacacagcangaactgagccagaaacgcagattgggctggctctgaagccaagcctcttcttacttcacccggctgggctcctcatttttacgggtaacagtgaagcttgggaaggggaacacagaccangaaagctcggtgagtgatggcaagaacgatgcctgcaggcattggaactttttccgttatcacccaggcctgattcactggcctggccggaanatcttctaaggcatggtcgggggaaaagggccaacaaactgtccttctttgagcaccaanccnnacccaancaagcagacnttttttttt

SEQ ID NO: 4308 - DNA, 719 bp, Homo sapiens
  misc_feature (1)...(719): n = A,T,C or G
gnnccagctcttgttctttttgcaggatccctcgattcgctgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatgggtttgacctaaattgctagacagtcgtgccattcacaaagtcagaaaatncagcaggaagagacgcttttanangggcagagaattagaggatggtggtagtaatgaaaatgatgc

SEQ ID NO: 4309 - DNA, 760 bp, Homo sapiens
  misc_feature (1)...(760): n = A,T,C or G
gggttnannttcnaanngctgggctangcgctttctgcaggancccatcgatncgttcggcacgaggtgacagagagcagttgaaatggttttttagttcctatggaaaagttgaagggttttggtctaaggaccagncacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggtnccctggcgttggtgacatgctgcagcctggaactctgatatccagtgtgactgcaaagctgtcttctcactggtactgccttgtgagtactggttggactgtggggcatgtggccgctgcagatccagtggttattnctaagnctatgacaggacaggctgancttgcntcanaaccttctctgacagacacgggaactaaatgtgaaaaaccaataanctggagactcatgaattcacacgaggaaaagcagaggnttattnatctgncttttcaacatttntttcctctgngaaangaanggtcanaggctttgnaaaagtggtaaaactaatcacatgggaagtgtaagggccancatccaagctaccaantcctaaangngncaaancanacctttngggaaaaaccnaattttnnaagcccgggntnnnnn

SEQ ID NO: 4310 - DNA, 809 bp, Homo sapiens
  misc_feature (1)...(809): n = A,T,C or G
ttnnaatngtnncttccctttcctaatngcttggcgtttttttccatttaaaagtattttatttttttccagtcaaatgactagttaacaagaaagagtaaacttattaaacatgctctaattataaatcactgcattaaggacaatgaaaataatcaatttcggttatacaatatatacagttgtgctgcaaccaaagtaatcaggtgaatgaactgaatatcatacatctcaaaatagcatcctaagctgcatattatgttatccaccccttaacagatcacacagttactcttagtctgtgtacatgttctgagccatcatcccagatctgatggagaatggcatgcaaaatgccagaatcctgcagctgcagttcatgaaacataaactttaaatataaatagatatctacaatgtttttctttctcttagttgcttttttaatttgcaaggagcaaataactaagaaaggatattagcagggtcgttaatataattctcctctggtaagagtactattagttactgcacaatagcacccaaattggtagactggaaaaatattcctanggtatttatgtcccagtggaacctgaccggattaagttttggggactgggagttctaaatggttggatattgaaatcaacctttaattcccttaatantaagcctnggcaacccaaggtngggtccaaaaagggcntggacctattaaaaaattccaggattgnccagggaagggatttgggttaaaaaaattgganccnttaaggtggccaccttggtggccaaaaaattnccat

SEQ ID NO: 4311 - DNA, 865 bp, Homo sapiens
  misc_feature (1)...(865): n = A,T,C or G
ggaaannttttcctaanacctggacaagaancagnaaaaacgngnctnggaaacttcctcttncncncagcannncnacattgggnctgggcacgaggttagagtaagtaanagatntngccnatttttgcacttaaanccaagaaagagagtcancaaatatttataccattctctcattaagtgacactggttccataaatttaaagacagcgggtcacccatatctatggnnttgcattncatgggttcagttaccacagtcagcctctgtctgaaaatattacaatggaaaattccagaaataaacaattcataagntttaagttgcatgccgatctgagnagcctgaatgaaaatcttacancatccccctncaancaggctaggncatgacatnanccccttgtccagccataatccaacactggttatggctacccaccccantaggnaacatantagccaaacnngggtattcaganccgancnggncntgggnaanccataanatgnctcggagnnccaagggnacccctnaaannntacccttaaaatagnggancccccaaaatggccanngaaatgggccaaaanngggaaanaaaccgggcccnaanncnaacaaantanngntaaacgggnncatnaaagnccccctnnaccagnggcccaaaaannactgnaantaaaaatcccantnaaaggggcnanataaattnnanggnaaaaaaacnagggngggaccnnagggncaggggcccaaaaagngggnctnnacanaaaccancngggangcnntaaaaanctatnancccgngggnaaaaggngngaanccccggaaannncaaaanntncccttgg

SEQ ID NO: 4312 - DNA, 940 bp, Homo sapiens
  misc_feature (1)...(940): n = A,T,C or G
ttcnctttcccncctcctnggaaacccttcctttcctaatgttcctaattcctcnnnnnctcnctctcnctctttctctgccggtcngggnncngtnncntnttgcctttttctcccgnttttnncnctngccnctacntnnccngntgaggnagnccacctgcggagaccgctgntnncncncannccgctngntgnttcntgnccgnntggctcanctccancgcctgntcccccctnnngtgncgccnngggntcngtngatcccncgatngccnttanggcttatacgaatgnncatgccttccgcacccnnncattnannnccgngcctctgctccctcctnacctnctgcngactgnctgcacctccctgcctctntgccncccnnntcgcccnggctcccaccccnngntgnttgccgntgcttncncntgtntcnnggaacggcnntgnncccttnncccccgnntcncngctcctggccncctnncccnttgnctgnttcnncccccctnctnnntngnnnctnncncccctcnnncntccncnncctcncnnnntcccccnnncnctcccnncnctnncnctcncnnntccnnncccccccncncccncnnncccttncctccnctnctctccncncccctccncnctncccntncctcccnctctncncnnncnncnncnnnnnnncncnccccncnnctccncncnncctccnncncnnnccntncntnnnncncnntncttncncnnntnnntccnnccnccccncnnntncnnncnncntnnncncctcncnnctctnntccnncnnnctctcntccnnnnnnnctcnnnccctctnnncntcncncntcnccncnnncncccctnncnncnnnntcnnnncnccccnncccncncnnntncnncctcncncncnnnnttnntncc

SEQ ID NO: 4313 - DNA, 1051 bp, Homo sapiens
  misc_feature (1)...(1051): n = A,T,C or G
cannnccnccnnaacnnnnatntcatcnanncacnannnaanccnncntacnaanatnctncgnacaacnagngannncttcccccccttnnaacccgcccttatgcngaacccacgattcgaattcggcacgagcccatcgtgcgctgccccacggttcggtaccacacgaaggtgcgcgccggccgcggcttcagcctggaggagctcagggtggccggcattcacaagaaggtggcccggaccatcggcatttctgcggatcccnaggaggcggaacaagtccacggagtccctgcangccaacgtgcancggctgaaggagtaccgctccaaaactcannctnatccccnaggaaagccatcggaccccaagaaggggagacagttctcgctgnanaacnggaaacttggacaccaanctnacccnnaccggcaatncccncnccggaaantctnaaancgaaannancaacgnncatacacaaacacnnannnancnngnncanancnnccncnncnnatnnttnnaacntcnncantcntncnnnntnccnctcnacccnanactannntnnnantnctatcacanannnagnccnnnnntcaacaannaccnnnancannnnaanncncnantcnnnnntancatncannntncnctcaacatnacatannantanntccnaannnctaatntanngcncnacnnccatctacncntnttntnaantgcctanaaancacnnccncncaactaanntcnacatanacgcannanatatatcgaacaaancataacgncacnnanaananattncnngngnaactacctannatantanaaacaccnannaccaaccanactcgnccacnngcnctcnctncnnnnngcgntcncncacacgtcngcnanccactntcttnccnnnccnncgctnatcncccgctccatnatannaccacaacnnnntcataacannntcgccnanancgacacctnatctcgncncgnganagannactctaagncacanatatntgttnaccc

SEQ ID NO: 4314 - DNA, 755 bp, Homo sapiens
  misc_feature (1)...(755): n = A,T,C or G
gatgctggntncnnatgcttgnngatccctcgattcgaattcggcacgaggaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtattacattttttatttttcaaattggatgataatttcttggaaacattttttatgttttagtaaacagtatttttttgntgtttcaaactgaagtttactgagagatccatcaaattgaacaatctgttgtaatttaaaattttggccacttttttcagattttacatcattcttgctgaacttcaacttgaaattgtnttttnttttctttttggatgtgaaggtgaacattcctgatttttgctgatgtgaaaaagccttggtattttacattttgaaaattcaaagaagcttaatataaaaggttgcattctctcaggaaaaagccatcttcttgnatatgtcntaaatgtatttttgncctcatataccggaaagttcttaattggattttaccagctgnaatgctttganggttttaaaaataataacatttttaataattttttaaaaggacaaactttcataatnatcccggngntcctttnccnnn

SEQ ID NO: 4315 - DNA, 811 bp, Homo sapiens; identical to SEQ ID NO: 3040
  misc_feature (1)...(811): n = A,T,C or G

SEQ ID NO: 4316 - DNA, 942 bp, Homo sapiens
  misc_feature (1)...(942): n = A,T,C or G
gnagcgtnnncctttggaacccnttgctacttgctctttttgcagggatcccatcgattcgaatncggcgcgngnctggncntaggcgtngnnnatnccaaggccatatnacatnngatnntncanaagagncatataatcnagnnngtaaattcacattgtgctgctcacatggatngaacatacaaattgatggttataaacctggatgctcaccatgactccaaagnnctnggtgntaaccatggntatagnggnagntcnnannggactnnatatggataccgaggctctccagaacaagctccangaantgatcactgngctancngnggctatgacagctgtaangcncgaacaggaatacntggaagtccgggtnanaatacactnagccatcancgactgcacatacagcatagtggtncttgtggtccttcttngaatctctngttctagncaccatgacattgngacagatntactacttgaagagatttttnnaagtccccagagntgcttaganaaagtcnactnctgangatccnacctnaagaattnaatgntnaccaaacaccntgntcntaataatggnccatagttttctcgcatgntttatggttctnggacttgtaccatttcacatcgtaatggtgnncanttngagaattaatcncattaattgggggngggaaanaacggccttttttanggcnaaattnaattaggccnaaaaatttttcccagtttaatttgggncnttaaacccttngtntttnaaancttgncctnccattnntgttanagttccntntcaaaatactttanaccctctttnntcaanttnnannattttnngnanttancnncatnccaancaattnnttnncnttncnnnttnacnnttttcccntgganttntcctgcacntcancntncnct

SEQ ID NO: 4317 - DNA, 891 bp, Homo sapiens; identical to SEQ ID NO: 4305
  misc_feature (1)...(891): n = A,T,C or G

SEQ ID NO: 4318 - DNA, 770 bp, Homo sapiens; identical to SEQ ID NO: 4306
  misc_feature (1)...(770): n = A,T,C or G

SEQ ID NO: 4319 - DNA, 765 bp, Homo sapiens
  misc_feature (1)...(765): n = A,T,C or G
tgttttaatnctngtcaaatccttggctactcgntcttttngnanncgnattcngnncggntcccatcnnttcgctggggtgggcagttntttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctnctcactgtatccaggttcccttccagaggagccaccagttctcatgggtggcactcagtctctttctctncagctggacttaaactttttttctggaccagttaatttttncaactactaatngaataaaggcagtttctaaaaaaaaaaaaaaaaaactcgaacctttanactatatgagtcgtttacgtagatcngactga

SEQ ID NO: 4320 - DNA, 744 bp, Homo sapiens
  misc_feature (1)...(744): n = A,T,C or G
gtnccnntttgaatncncatacaagctacttgttctttttgcaggatcccatcgattcgaattcggcacgagcttatctgtacgagatncattccnagacccctagtggatgcctgaaacctcagatngnactgaaccctttatgaactatgttttttcagtctgacaaccaaggcggctactaagtgactaaggggcaggtagtatacagtgtggataagcaggacaaaggggtgattcacatcccagcctgngcaacagagcaagactctgtctcaaaaaaaaaaaaaaaagtctcantaacctatgggataatatactaacaaacagctgtgtaactggaatnccataaagcantggtggacanagcagaaaaatatttgaagaaataaagactaaaattatgtccantttgatgaaaattatnctctgacagatctaagantttnagcaaaccctaatcaagatagtctctctctccctctcacatgcacgcacacgcaccgaagttnagccataatcaaactactaaaaaccantaataaaangaataatcttaaaatgtngccagagaaaaaangacacgttacaaacagaagaacangggttagaaaactgaaactttccttanaaactacatacgcagaagacaacaaatttgcttaaattgtgaaaaatcccctcacactagagagaggctttggtggtagcatggctnagtaggtgcacaagacgtgccctcct

SEQ ID NO: 4321 - DNA, 772 bp, Homo sapiens
  misc_feature (1)...(772): n = A,T,C or G
gnttgnngtntaantttntaaggatccctttntntgaanccctttctgcaggatcccatcgattcgaattcggcacgaggcaggagnaatcacttgaaccctggaggttncggttgcagtgagcacagatcatgccactgcactccagcctgggcaacaaaacgagacttcgtctcaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgntttactttgaatatagaatagtttttttaattagggcttattttgaaaaattctgagtttaattcaaatgtatgccaataccttccaaagtaaggtaatattcagagacagttgttggtgatcagatggcttagagaaaatttctggaatattcacattcgaagatccttattatgaatgtctttgacttaaatctaaccaaaaactgcacattattctttgnacattttcattatatagngttaacaagcttanttgcaaaccaataaatacttaagctatttaaaaaaaaaaaaaaaaaactcnc

SEQ ID NO: 4322 - DNA, 749 bp, Homo sapiens
  misc_feature (1)...(749): n = A,T,C or G
tnnctttnactntnntaatcctttntgangcccttntgcaggatcccatcgattcgcgtctgtaatcccagctgcttgggaggctgaggcangagaatcacttgaaccctggaggtggcggttgcagtgagcacagatcatgccactgcactccagcctgggcaacaaaacgagacttcgtctcaaaaaaaaaaaacatanaatttggatcctttggtcnggttctcccaaattcttttgaggtgtccatggtcaactgcttcagctttgntttggcaacccnctgcccgaantcccatataggctgnncttcaccttgtttccaangctgaggaacagaaagtancctctgtttngaggaggtggaanttaagtatacatttatcctntactgcgacttgntcangaccacattttacaaaatgcctngtttccttcatngcttctgnaaaggaaagtnctattantatngtgttactnagaatatagantactttttttnattntggcttattttnaaaaattctgagtttaattcaaatgtntgccaataccttncaaagtaaggtaatntcatagacantngttgtnatcacatggcnttacanaaantnctggatattcacnttctaaanattccctattaaatgaatgtctttgacttaaatntaccaaaactgcncatattctcgtacatttcgtaaatngtgnacaagctanttgcaaacaataaatacntaactaaaana

SEQ ID NO: 4323 - DNA, 773 bp, Homo sapiens
  misc_feature (1)...(773): n = A,T,C or G
nttnngtttttantttntnnaancctttgttacntgcnctttctgcaggatcccatcgattcgccagcccctcctctccccgccttctgggaggaggaggtcacncgctgatgggcactggagaggccagaagagactcanaggagcgggctgccttccgcctggggctccctgtgacctctcagtcccctggcccggccagccaccgtccccagcacccaagcatgcaattgcctgtcccccccggccagcctcccccacttgatgtttgtgttttgtttggggggatatttttcataattatttaaaagacaggccgggcgcggtggctcacgtctgtaatcccagcactttgggaggctgaggcgggcggatcacctgangttgggagttcaagaccagcctggccaacatggggaaaccccgtctctactaaaaatacaaaaaattagcccgggtgtggtggcgcgtgcctataatcccagctactcgggaggctgaggcaggagaatcgcttgaacccgggaggtgggggttgcggtgagccaagatcgcaccattgcacttcagcctgggcaacaagagcgaaactctgtctcaaaataaattaaaaaataaaagacagaagcaaggggtgcctaaaatctagacttggggtccacaccgggcancggggttgcaacccaacaacctggtaggctncatttctttccaagcccgaacagaaggtcatgccggccccacangaaaancnggcagggccncggggggct

SEQ ID NO: 4324 - DNA, 916 bp, Homo sapiens
  misc_feature (1)...(916): n = A,T,C or G
nttccnnngnaanttncgngnatnntgncngaacccctttcgatnncnnngattcgnagtacngacnaggagannctgncggncntgtgntggaanctnnntttggaccncnctttnnccngtgccntgtgaactcagagcacgggcnntttggaccnactcaaggccantcatggcatggctcatncctgaggcacgnannganactacattcncaggngcccttcnaaacaatggaccncnatgcnggcatactgngcctgcgacccnaaanacnnnangnntgtactgaatatcaagatcnacttagantctaagagagnntggnctnnnaactgatcancanggccttccanggggcancanngagacactgcgagtnacagagacngccatgggcgntgctnccttacnnagngncacaggccnnaccntcatgnaaccctaangctgtncnnatgtactccgaatggcctttnanncgnacnggcctctaagtgatgcnncccggtntcanatgnnnccgtacaatatctcangggacatggggantnatnnncanccnnaacctttnanaaaaggcggcnttaccnttacnnnaaaaggatggcttnnngctaatcaaaaancntgtaaaccctnggcnattataaacccaagacccgggacaaanctnggggtaccnngtccaattnaaactggcctnccnntcntggtcncccaaccaaagtnaaacctanttngcagngggttataccggnanncnaattggntncaaccccaacttngggaaaataatttttncnaaatgcntcnatcnaaccctgncttttnnanaaaaacccaggctttttnnctnggggaaccttnaancgggganttggccttnncaaaaccacntnccnctttaggtnnn

SEQ ID NO: 4325 - DNA, 757 bp, Homo sapiens
  misc_feature (1)...(757): n = A,T,C or G
cnttnnttnatgacccttgttacttgctctttttgcaggatcccatcgattcgaattcggcacgagggaaccatgagaaccgaagctagaattgntattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaagacactgggtttagacattggatattttaatgattgtgtgtctaattcatggtgctgncaactgagttatctagtgatatgacctcactgtcttgaccaaagccagaatngaaggcaggattcctgaatctatcttaaaattgcaatggaanagccttttccctaaattatccatttgtaatt

SEQ ID NO: 4326 - DNA, 758 bp, Homo sapiens
  misc_feature (1)...(758): n = A,T,C or G
ntnnnttctnaatccttgttcncgcctttctgcaggatcccatcgattcggagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagcttccagttggagaaaatggaattgnctaagccaaaagaaagtctaattatatacagagataaagctaaacgtaattattatttaaatgaaagctatttttttaaatgaatngaaatttttcatgatgctactaatttgncactaaatctgcaaatggtcaccctgaatttcttctgacattggtgntatttgcttatattccttataattttaaatgaaggcacagtgaaatgaaaattttatactctatgnntctggnaatttntaaatccttaacagccaaattttttgcctttaattcttttanatatatactctcgagaaatcn

SEQ ID NO: 4327 - DNA, 757 bp, Homo sapiens
  misc_feature (1)...(757): n = A,T,C or G
ngtanantannaacntggttntcgctctttctgcaggatccctcgattcgaattcggcacgagccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattaacaaatatatttccgattggaatacaaaaaaaaaaaaaaaaaaactcgagcctntagactatagtgagtcgtattaccgtgatccngaccatgataagatccattgatgagtttggacaaccacactngatgcaggaaaaaat

SEQ ID NO: 4328 - DNA, 757 bp, Homo sapiens; identical to SEQ ID NO: 4327
  misc_feature (1)...(757): n = A,T,C or G

SEQ ID NO: 4329 - DNA, 746 bp, Homo sapiens
  misc_feature (1)...(746): n = A,T,C or G
ttntttacctttgctcttgntcttttgcaggatccctcgattcgaattcggcacgagagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctgggtagataatctggtaataaatgataggtaaatcaaaaattacttttatttaggagtttgaattcttactctcatcagacattttttttctagggacgcttactaattaaatgnatttaagttgnttctaagggttttttgcctatatatttatgactgngttaatgagtantgaaatgatgcggaaggcagcttcaggaagaggaatncagaacctgaataatctatgggttagaaaagcttcctgaatatcaaaattggcngtt

SEQ ID NO: 4330 - DNA, 967 bp, Homo sapiens
  misc_feature (1)...(967): n = A,T,C or G
nnnnnncannannnnnnnnangnnnncnnaccannncnnncnacnnagngnncccgctccaaagccggcaanncgccgcncngcnnnntcaaaccntgcangcggcacnngnngnncccnacgangcgccagcgcgcgnganacngngctgccaagaaangngngcncanagnccggcctngagaacagnacagnggancgtcanaagcagngggangacagacgacngangaaacntagagcccagggnnagcgngacgacggaccagntcccaaaggcnggngcccaaagcngacnagntnnaggaagaaanacgngggacacaaccggagacanccgannaggagcngacnganntggacccananggcaagaagcaccnaaacangncacccaccanacgaccggggaaggcacgaacggtcngagcacgagnaaaacgngaacnaancaacgcgcacacanngngaganagaaacaccncnaacaancnaancgngggaanangnagaccggacncagaagaanggcncaaganncggcanngaacccnnaancngacggaanncagggncggngccaacaaganggcnangacnggncaannnanggccggcnnggaaaaacgaccaagnngnncnccaaaaaagacanggcaaaagnaaacgggcaaagggcaancncnaaggnnaagcccnanaacgcgcannnggagcaaaangnnccaagngaggancnaaaganggggaaaggggcccacnaagngggcggnnaannggcgaannnaaaacanagggngggggccacnggnaaacccaagcgcgaaannccnggcncnaagggccccgaaaacanggggngacaaaaacccnngccaaaaccnnangggngggncccatcgngannacanaaggngaaccgnccaagggggcanaaaggaaaggccatnnnaangnaaaagagccg

SEQ ID NO: 4331 - DNA, 824 bp, Homo sapiens
  misc_feature (1)...(824): n = A,T,C or G
gttagngtgnggtatnaacagctcttgtngtttttgcggatccctcgattcgaattcggcacgaggcnacnggtgaagcnnntgttgngtgngctnctcatgaagaanctgtggcnggtatgttcaaagacanggncnatatgcantacagatatatagaactcttcttgaattnaccaacangggccggntaatggggcgnatgtcagncaantgatncaactgcatgngggtgtctnntgcccaggncacttacagnggnctggaaagccagtcanngcaangngtggncncagcgcnggnttcngtgggtnaaccaggcatggnctggntatnacgtaatcttagnnaggaacaatttnagtnactntnttcntnattcncnngngagncctcttncangttngtgagcatttntcaataagaaagaagnctggggnacccatttngcancattnanttcanggaaaaatctngatttaaaaaagttacctntgaactgttnnntaangcncnntttnnttgtagcntgtgataatngatgcgaacttntactatttatcagcatgttctnannataacnttttgggtannatcngtttagnantgattcnttcatnagcctaagaaaacttaagnnnnggcaaaatgccggatcattgtcacaggcacgttcacnaattnanccncnctcggtgacaacntttcttgntttttnggaaanaaattccacagggnctagnctanncatngnttcntnggaaatttanctntaatggtttcggtanaantcccgtttgngnggtttnaattaaaaaaanccg

SEQ ID NO: 4332 - DNA, 830 bp, Homo sapiens
  misc_feature (1)...(830): n = A,T,C or G
gcttnanccctttccatttccaatnntttggctctcnctnaaaccctttggancccntcgattcgaatncggcacgagggctaacttgccttgttnnactatngatgttngngtcctgnnttcttaacactttaagcagctgntctcacctaaaggctaatagttntaagtaagtatctntttctttttataatttaaaaattaaaaaatttttaattaactgtttttaaattaaaaaaaattattaatnatttntaatagacaggatctngctatgctgnccaggctggtcttgaactcctggtctcaagtgatcctcctgccttggcctcccaaagtgctggtattacaggtgtgagtcactgcacctggccaagttnnatncttcaggntacattncttcagccacttcaatcaaacatnnaattaacatgctataatgaatgactatncttaactaggctaaccaaatgaaggcctttggnaacttacctntagttacanccttcacttctttttttttgngaagggaaantnnngggnncggacaatactcctngnantnaactatngtaaccctttncntngactngaattaacnngggaaattnggggaaantaattgnagaantgaacnngcttgaatcnaanannantcaatanaccntaatagncaantcntnttaannccccnaatcnnttagncctntccaatttggccnanaagntaanancncccccnggccttttngccccaatcnnnaaattcgnnatnaaaaatnaaacccctngcctttaaangggnacctttnacacgaangggggaaann

SEQ ID NO: 4333 - DNA, 772 bp, Homo sapiens
  misc_feature (1)...(772): n = A,T,C or G
gnnnnnntttnnnnnnntttccnannngnnnnnttcaaattttccnaatcgctngnctttttgcaggatcccatcgattcgcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagttttttttctgttgtggtggtttttgttttggtttttggtttgtaagattctaaataaattaaatcgantnaaaaaaaaaaaaaaaaactcgagcctttanaactatn

SEQ ID NO: 4334 - DNA, 729 bp, Homo sapiens
  misc_feature (1)...(729): n = A,T,C or G
gngnntttgaaanccntggctacttgttctttttgcaggatcccatcgattcgaattcggcacgagacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttntgctgctgatatattagaataatttttaaatgtcatcttgaaatanaaatatgtattttaagcactcacgcaaaggtaaatgcacacgttttaaatgtgtgtgttgctaatctttccatangaattgtnaacattgactgacaaattacctataatggatntggttaatgacttatgagcaactggnttggccagacagtatacccaaacttttatataatatcagaagntatcaccttgtgaaa

SEQ ID NO: 4335 - DNA, 750 bp, Homo sapiens
  misc_feature (1)...(750): n = A,T,C or G
tcggcctttcaaatnccttttctatttcnaatncttggctactttcactttccgcanngatcccntcgntaaaggcagcccccaagtcccagaaagctgactcccctagcatcgactacgcagagctgctgcngcactttgagaaggtccagacaagcacctggaagtgcggcaccagcggagcgggcgtggggaccacctggaccggagggttgtcctntgacangcctggcacggangagggcccaccgagtggaccntnaancactacnggtcntnaaacacntncgatgaggccatatctactaacttaggcccatggtcagatatgatnatctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaaacggagaggctggcttggctgttccttgttattccgaaagccctggtttggggcccatgttcacactggctctcagtctagtcaggtgcaatgttcttgaanangtggggacctaattattaccanagtagcancaagagaggaaacgttgtgaattaaagtattcaattaaaaaggaaacatgatttctacctgaaaaaaaaaatggctgcnancggataatngtntgncccntgntttnnanccggagnccnnnnaccat

SEQ ID NO: 4336 - DNA, 991 bp, Homo sapiens
  misc_feature (1)...(991): n = A,T,C or G
ggggncattttgcnaaantccccgcngtttttncccngtnnttgccnaaaaanagncccntttgggggcncccccntnttttgccaaaaanatccnnccctaggggcctaacctatgggctgcnntatangngggncagggggagaanccccgcnaaangcgnnaanganggangnaaannaacgggggcacacacgcncnagngggcagngncnncnanggggnagannngnncagggancagnggggnnngnncntnccgancananacnnggnggggagaannncnagagggnaagnncaccncncganaagngnganagggnggnancntgnannacgacnanactnggnggngcaanccgnaanngagacgangananaggngtncnanggcgcaaagnagnantacncgcncnnnngatacagnaaaaaggannnaaannnacngcnanganagagngananacnacaanctntggaggaagagacggaanacngggagaggaagggntnagnaannaaaggcaaggattaacctnacagaaatgaanaancccnanncacnggngncntctgcaagngaaccacttnaagccaangtnaagcagntgcagcttgatagcctgctaccactgagagggactcagaagagtgtactncattgcaatacttaaacagcgccatcttgctgtggaagcctacagaaaactgnggatgaacacaagaaaacgatggaattactgcagagtgatatgaatcagcacttcntgaaggagactcctgggaagcaaccagancattccggcaccttcagncacatcagnacttggcaataaaacccacagngagaattggaaaacagatggggnganagaactggccctctggaaaagacagcttnggacaaggtcaccaacngaccagatccnggnaaaaaatccaaggcataaaggaaagaagannggtccaaatctcaggggatccaacc

SEQ ID NO: 4337 - DNA, 1188 bp, Homo sapiens
  misc_feature (1)...(1188): n = A,T,C or G
ccttaaaaaattggggccctttggggcctttacttcngggtagaatncttttttnttggnccaggggaaatccccccanttccgcnaanaaancgggaaaatttgtgccgggggccaaccggaagggaaacnttcttgggggnccacccaaaggccccccagggnaaggtttccaaatttngggtnttccctttttttncnaaagggccnaaggtttccnattttttcccaatttaattcccaaaggcccngntnnatnntgnctangtncgnnnnncnnatntntnnanngngggcgnnanattnnntcntntntnntntgtcnntcnnnnntnnnnntnntaanncnttattnatntnntatncagccncnnntanannnantnctnnnaatnntnnttntnntactcnncnnattnnntngtngtcnnctncntttanntcatcatacnnatatcatntaaanaangcntnnactncntatnatccnttngcatcttcantgttttnttnctcanctncttgcntcnnntntacantaccantnnttaagctctttttacnatgnaatactcannaagagntngaggttggctgnantttanctttntaaantcnttgtccnntgggctcntgaactttttnnannttgttggccctttnacttttactntnnatnanatgggantncgntnnaatctntnttcatanaatttttgtacnnntaancgttgatnttagnanaaactacnaggnacctnnntttcantaggnttttattcctnttttnaaccnttnntttgatatnttcttaactatnngcanancnttacntnancntntcnntttgnntaaaatgngnatnggnnnacnncnatangaccctnnagctccnncattttccttnaananagcncanttcnantattctattnnaatcaatnntatcantcgngcttgctcttttnancnnancatangatntncanggtatntntangccnanntncnaactantntgcactcnactatcncancgntaataagacntatanaangntcntnnnatnnaaccntttgnctnacantnatnttgtacatannttcctcncnnanannnnagnntnannttatnatnttncatatcanncnatanactntaataagtactntataaanttncgnncg

SEQ ID NO: 4338 - DNA, 941 bp, Homo sapiens
  misc_feature (1)...(941): n = A,T,C or G
ggggttttnaataccttgctncttnttntttatgcangatncnntcgattcgnatnncncgcgaagntggcnnatgcngacanggccngttctgnatgannaatgnncatctatntccctcccaaangggcgncccanggatatgtcttgggatccnattncacccatgacgcctactncntgctncttcctctnntgctcnggtnttgtncacaaatnnnnnggnancatccnngncngtccattggagatgtcgngnataaactgcnntagatgtntnctaacactgntgnaaatgacgagcatncttatgagacgaaggcntccnaagcngtagntgcccangatncgaggtangctatgtggtctcttatctaatctagaaatgaaaacgccctgtntnncagcgaaanntanggnacgnntgnacactngcttnaacnnaancttanatacaacaggggaagggaaattgggggggaaaccattgacaggncttatcanatagggnttaaatnagaggacccaccgnttgtaatnaacatgnngattnatttgggggaatacggatncaanaggtnccaggttncacttggtttntttttaaccttatggccnantanncggttcaatttggattttggggangccccttttncattttgggaanattnggagcccnctaatggncgnggaancantttgtnggntncccccaatcntaatggggacccctntnanaaaacctcnggggggtgganccccntccttaaacccaannacgctttnnttgggtttnccaanaaangcnnaccccccggaaaacttnccctttnngngnnaatttctncaaccccccggggnggaattttccctngngaaattggcaattcccngtttnaagggtgcccaaaaattccngntttttggcccncaatacc

SEQ ID NO: 4339 - DNA, 740 bp, Homo sapiens
  misc_feature (1)...(740): n = A,T,C or G
gngngggnnnnnnncnatntatacatacaggctacttgttctttttgcaggatcccatcgattcgaattcggcacgaggctcctggcatgaagaagatcaagttagacactccagaggaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacacattctgtgatacccaaggaagtgacaccagccctatgctcactaatgagtagctatggcagtctttcagggtcagagagtgagcccagaagaaacttccatcaagacttgaacagacgttttggcagaaaaccaggttcttgatagcagtgctcctaagagtccaagtcaagatgttaaagccaactgttagaaatttttcagaaccaagagtgagaaccgaaagaaaagcttttgaaaaaccaacccttaagaggaaaaaaagattttcccactntc

SEQ ID NO: 4340 - DNA, 890 bp, Homo sapiens
  misc_feature (1)...(890): n = A,T,C or G
angttggaaanccngncntttcaaatanctaggctactcgttctttttgcaggtatcccatcgattcgaatncggcacgaggnccnttggngtnggnnattntncannaatnntnnacggacannncttcgcnattatggtgntcttgggtgntngggnttgttggttaaccctacatcataangcattnaatgnattanatnttgtnattgntgncaaaanggaatagggtcnacaantnctgtgngnatnnaacctgnntcanatngcntttggnaatnttctntacncnnntttnaattccactgtaaatnntgacngattantnccnantggnttntcnttggagaaaatnnattttncactcncngtctncacnttntatnaagcgtattttatgctggcnggnccnccatanatctacncccctttgatgcctntggnnanaaataatgttaantagtgcgcaaantngntattgtnntgnggacaancntaaatgngccattannggcntacnatgcnnttatgccacannaccanncngcnanngnttttgattangggnangcattccntaaacaacccngcncnatgaactngaactngnttgggaattnantnngggaatnaanttggcgntnatgggtgnngggnccgcctttaccccgnccacanaaattccttgngcaatttnnnnctttaaaaggnccananggcnttaatgggnttnggnaacttntaanccttttttttgtttgctntttanggngtggccnagatggcacaancnncnngaantntnggtgcntnaacctctgnttnaannctaantaggggantgccaaatggnttttnnctttngcnccnaatantntttttcttgggng

SEQ ID NO: 4341 - DNA, 776 bp, Homo sapiens
  misc_feature (1)...(776): n = A,T,C or G
ntgnnnnnnttnncccctttcnaatcncttggctactngttctttttgcaggatcccatcgattcgggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaaggtgtacttcaccagcaagaagtcaactctagaaattcaaggatgttccttctaattggtttcttaagccatctgtcanggaaatggtaactttnggntttaatttttnggcttaattcccaaggggggtaaagcccagnaaaaattngaaaaatggaattattttcctggattaaatnagcncgnaaaccttttttcnaattcttcaaattnttttaaangggggtcttgcttctttttnaaaagcctnt

SEQ ID NO: 4342 - DNA, 752 bp, Homo sapiens
  misc_feature (1)...(752): n = A,T,C or G
ntggannnctttcccctttctaatncttggctactngttctttntgcaggatcccatcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggcccttngggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacaagtgatgttattagcaactgtgtggtgggagtaggttgtnggcttggacaaaatcaatccgngtgggaaaattgttaggaagttttattacatttaaacttggntaacctaaaatcccntcaaaanaaaannantctngnccaaanttaagggtntnnnaatnaaaaaaactttngnncctttaaaacttntcgngngccntnttaacgttaaatcccgncatngntacgaatccnttggttgaattttngccaaacccacttt

SEQ ID NO: 4343 - DNA, 1069 bp, Homo sapiens
  misc_feature (1)...(1069): n = A,T,C or G
gcncaannacangannnnnnnnnnaanaaacaacccnaaannannngnaccnannannnannnganngnngnancagnaggnnangngtnanccgcnnggaaaccctgcgacccacgancggnggaaccggcnnaggccggacaccnnggcngnggncacgcggnacagnaggccacggggagcagaacacngnanacggcnnngaaaccnncccaccancanagagagannggaagtgacagcacanntgganaagncnaagacccanangacgcagaaaacaangggacangaggcgaangcanangnggaaaaananagcggaagaacaganacggagacaagncaccaccgnnangncagaggccancganaccnnggnnngccngancaanagacaaacnccgacncannanangcggccnggannanncngaggangcaaaagagagaaangaagccagggaagganacnngncatncnnnccnncnnacgaanggaaacgagnaanncagcanggcnggacacaacgacacnggaagcaannnncgnanggaacngaaacnanccgaagaannggancgggngnnaatcaaaagnggaaccnnncgaangnccancncancaagggcnnnccaangngccannaannngncnaaaaagcgcccnccaagagggncgacgangacgnaacnagagnccgacgggnagncgaagaccaaancagnnnccaangaangcagaannggagcnaagcccnngaannnganaaaaaangggcncgggncncacnacgaagcccccanaagggggaaanaacgnagaggggnaacagagcccnannnnnngcgngnganangacacaggannacaaangngaaaaggganccacancanngnaaacccgggcaaggggaaacncccaanngcaaagaagaaagaacagagcacgcaaagcagaaangnaacaganaacaagggaacnaaagagcgngacacagnancnaanggcaacnannngnaggcnacccacgncanngnnangccnnnagnacanncgcnanncg

SEQ ID NO: 4344 - DNA, 459 bp, Homo sapiens
  misc_feature (1)...(459): n = A,T,C or G
ttgatccatatanatacnnctanttntgcaggatccctcgattcgaattcggcacgagncncatnccnaccactactgatgantatnntncaaagagngatacnctntgnctnatggnntnaacnctcnttatccaantgggnaaggaacttggcnccggangacgcagatgtgtncacctcattntcaaggaaanctgtgaancccctgcctccttttncttgcctcngantgtntgtgacnacancggacnctnnnnncatcncnancntgtagngnaacggnantggaanatcngtgcactcgtntatnnnacngngagggaccatnnaccnaagncancttagcaaantggcttngatgctgtggctgannancnactgcnggtgcattcggacacatttgcccatnacnctgangcncatttctgnggggtcaagntcatnctgatcttntgng

SEQ ID NO: 4345 - DNA, 784 bp, Homo sapiens
  misc_feature (1)...(784): n = A,T,C or G
ttnnaacctttgcatttganccctttgcaggatccctcgattccaagnngncacnaggtnngctgnacncttggctaaggnnactgattctgngcnccctacccatgttcatggnangnccgngcctnctctggccatntgccncaacgantattcntnncccnnaattgctnatntcttgggatantagnntanntganngatttngcaagacnagaangtntctacnnntctgnccannacgtncgctacttntnaggccttaacaaatcttggncatgcatggnatatatatcttcctaangnaccncatgncaggntccatnccattcattgaatgccaangatanaccagctnctggtncnnaagnagtnntnagncancntancaaaganccnngggcccntggngnttgacancattcatcgtggaggaacaatggannnagtctnactttcncnanncnannttctgattnaaggnttgtgaaagagtattacatnancgtgnanntcanggntgatntancncanaaatggcanctttnncttgcatcnagggtctnggcccctttntncataaaaannggatctgaataggctttnntanttaccnncnncacaccnnatgnantaanctaaccctttgcnaangttagnnnnctttaccacanaggtcnttacncaaaantannnggtnanaaccccngccanttttctagattantncccaacttangccctgncatncacttgatacanggcccccttattanaatgaact

SEQ ID NO: 4346 - DNA, 887 bp, Homo sapiens
  misc_feature (1)...(887): n = A,T,C or G
caaancctttgccccttttcaaatcncttggctactcgttctttttgcaggatcccatcgattcgntgctgcgactcaggcncnntgnatggnaantgacataatgtnancnanangcnctctgntgtatgagttgtgcttggtttgnncnagnaggaaactgngnnntntataactacnccnangccntttggacaacagctgggatccaaccnttgctnntngnnnnantgttcttttcagnncctcntgggntagaccanaacanttccttgtnaanccnaacnngncaaaacntngnancagggntncgtnncccaangtnnttnnttanngnccccnnngnngnaaacnntttcaaccccttgnctttggnanaanncttngggccntnaaaatnnnttnnatannaccttnnntggggattcntttaatttctantnaaangttggtggtccnattttaacctnnaaaatgnntngcaatgnnnacttataacccttanatcgnttgncttaattgaaancnttaacngtctaaacnccttnagctaaanctcccaatatcgnnggtaacccnggngnatgnntnggggccaatggnnntttcaannnnnctnnaagatcctcngnatnnnnagaaggatatntnccnncntgggantanttctctgnnntattcnnncgaaaaaganacctttgncctcttnnnattgnaatattngcctngtnttaaaancgnngncccanttttgggggaatatnnnntttctnngananaaaaatggggcccncctgggntactttatatcnttntnnngaaaannccgncnaanatcctncatatggttggntcntttcatgacngcggggnttanttnntncccg

SEQ ID NO: 4347 - DNA, 463 bp, Homo sapiens
  misc_feature (1)...(463): n = A,T,C or G
tattcnatctgctacttgttctttttgcaggatcccatcgattcgagannaggangaangacnctntgcntggnacagggctntgnccctantctgaatatgtcattccnncacggngancnnnagcctttnnntctccccatntttggnaattactttcttgangatgctgcctttnaaangcttcncgtacattatccatntttaaaaaaatctntggactggatctactgaagcgccnttgctntattaanntnagggcctcnagcacctaaanntctngaccatnnnaagacattnntncattnnactnctttgtataactaaatactctntannnatttcnnttncaatacngtgganggnaatganaagcatnctaaanttgggtnaatntanttcnntnannatgtnngacnaaagaagaaaatngcttgtnttcaggttcatnggcttgtgctgg

SEQ ID NO: 4348 - DNA, 765 bp, Homo sapiens
  misc_feature (1)...(765): n = A,T,C or G
tttcnaatgcttggctactngttctttctgcaggatcccatcgattcgaattcggcacgagccngtntntnctaatnntnnnatgntnacctgggnntggtggtgggnngcntgcagnnccanctactcagggngctgnggcatnanantngcnngaacccaannggtggnagttgctgnnatccgaggttgcacactngnactccancctgnccacanatcgagactngtcttataaaaantaannngannatgnnagacctatcagtagggtgancacntgtccttnngctntgcngntcnacnttnatgcgatgngatccantgangttnaaccccnttccactnnntngnnaantcntnnnttacatnctgtgntccccaaaacatntcacgtaacanttattcctaggtgcagnctcnctatcnntaggntcttggtnggccaaattcctgggatcangtgaaggtgggctgtntcagtaanaantgaatggactgnanagngcccattttacaaggaccatncttnctgggggcaagccaataaattatttnccctntttgggggaaaanaattttcgganccntaaattanatttcnggaaaccnncccnaaagncttnattttcccnnnacaaannttngngganncatttttanggggnnannanaggngnnaagggtttcngttggnttngcccntaanttcccaaggncntngaaacccttatggggnnaccncattcnggataatttgnnaan

SEQ ID NO: 4349 - DNA, 891 bp, Homo sapiens
  misc_feature (1)...(891): n = A,T,C or G
gtcntctttgaaanccctttgctacttgctctttctgnaggnaggcatcccatcgattcgccnacgcncngngngcaggcgggttgctnatggngcnctcttccgcttncttgntnaatnactntctgnnctngctcgntcngctgctgnnancggaannanctcnntctaaggcggtgatncnnatatccacagantnaggggataacncnagacngaacntgtgatcgaaaggccaacagatngcctanaaccgtaaanangcanantagcngncctatatccatangctngctgcncntgactagcatatcatanatgtcactgtcatgtncntncntngaaaagnccgtnaggnntnttatgatacnnggcnnnttcacttggannccanntcaagcncncngctgttacaatgctgnngctgaatgnatacccgtccnacntgntnnattaggnaacntgggatcncttctatncactgtnacnctcatggggttttgggnaaatgcccaangnnnngnccgnnattccncccgnaagntttgnggnatgttgttgnngaccgnaaaccccttggncgttaccaattgggggggaaanaaccttgttgggccttttaaaccccgnggtaaaaaccttnatacggaaattttaggagtttgnccanatnccccggnggntnaaggccnnacccaattgtttaaattccccccaacnttgncctttgnnnnaanggnccttggtnaaaccggggggaaattccccttngaacancgnantagggtngggcanggcnttttanagggantcccctngaaaagcggctggnnggtnaacntttcgggctttggggttgaacangnantctncaaattngggaaatcntgg

SEQ ID NO: 4350 - DNA, 812 bp, Homo sapiens
  misc_feature (1)...(812): n = A,T,C or G
ttnctaannnntncttnnnannnnntggganctttnnctnnctccannnatncnanntgcnttncggtttgggagtcaggcctgggcaggaccctgctgactcgtggcgcgggatctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggtacctcccttccccaaggttccagaggccctaagcnggatgggctcgctgaacctcgaggaactccaggacgaggaggacatgggacttgcgtggacagtcagggttcacttgggctctctctanctccccaattctgcctgcctcctccttccnanctgcactttanccctagaangtggnngacctnanggggaanggacaagggcaaggngggccccatgaaaaaaaagcccctcnnttgnccnacacttgncttgannnnctngcttcttnctggtggccccanangntnggnnttnnccaaccccacctgggatttncttgcccnttgggggnngnacttggcccctttcctnggnttttttgccnncacnngggccttcnttgggaacctttgtcaccct

SEQ ID NO: 4351 - DNA, 938 bp, Homo sapiens
  misc_feature (1)...(938): n = A,T,C or G
ntttctaaaatggccctgggncccctttttccnaaaatcccctttgggcctncttttncnaaaaatcgcctttgggcnaactccgnatncttatntggacangggaatcccatccgantntccgganatttcggggccaccggaggggaatttngtggnaccatggggtcgggttacaatnananaggggtaantnaccattgggatggttaaaatnanaaagggccaatcaccattgggacngttacataaaagngnatcgctgnggcaagccaccaaacaattcccatnanggaaattttnnagaacttttannggaatntggcncaaattnttcaagggcccntttanttctcagancaccccggnccttnttggatnaatganggctggcggnngnntggagnaaaanngacccannttaaatngggnnaccnnnatgaaaggttnggcncnngaatgaacccccgtaccctnaaggccgttantccnaantnganacntaaaactnnacnaaaaccattgtctgggnccaactaatggcggaccnttggccaacctaannttttaacngnncatnggaccnaancatnnaaanccnggaacagncggaaaaanaggncgtganactnngataatgncatcnggaacnnctgaccctgnnnttccctatgangggcaaaaaaaaggcctccnaagggtnngacccntttnattnnccccnttncganccaacgcnttcattncccctcncagggggnntcaaananggccntcnccncntgnaaaacgacngtcccctggggccttttccaataanatnncncccctttnntnaccccnnnntaaaaanccgngggngaanaaaagtcccctnaaaaaatattccccccnnncncntgnccnaccactnaatnctcaaatnaaanccntttcnc

SEQ ID NO: 4352 - DNA, 938 bp, Homo sapiens; identical to SEQ ID NO: 4351
  misc_feature (1)...(938): n = A,T,C or G

SEQ ID NO: 4353 - DNA, 599 bp, Homo sapiens
  misc_feature (1)...(599): n = A,T,C or G
gnnnnnnnnnngnnnnnnnnnnnnnnnnnnnannnnnnannnnnannnannnnngngnnnnnnnnnnnnnnnnnnnnnnnnnnnnnnnannncnangtggaaaancccgtncccnnnnncngggnaccatcnnngncgggaanccgaagnggaaggngantncggggnnccggangaaaancangggtgttggggggggggggccgtatcannngaccanggggngaagcacttnggnanagggagcaaagacacantatgtaaaccnaggaggaggagaagaangcaaannngcatgngaaatnnagnttgaagaancgctttttttgctnttcagcaatggtatnnatgaacaacaaaaatatagaaaaagngagaaaaaggcaannatnaantatnnnctgaggaacaacaacaaagacaaaaaaatggggggggattgatttantntcccctgacaagaaaaagaatnggatctttagggnctaatgcaacctggcagactcactgagggngaanggaatgngctgaaaaaattcnagcctgacntggcaagctcccaangggacaccaccncaatggagaagaaagcaggaaag

SEQ ID NO: 4354 - DNA, 812 bp, Homo sapiens; identical to SEQ ID NO: 4350
  misc_feature (1)...(812): n = A,T,C or G

SEQ ID NO: 4355 - DNA, 819 bp, Homo sapiens
  misc_feature (1)...(819): n = A,T,C or G
gcttnaatgcttntctaatgcttggctatgcggatccctcgantcgaattcggcacgaggacctatcttgatctggatagtaaagtgaggactttaaaaaagtttnttaaattactgggagaaatcatggagcacagattcaagacttttcancatttaaaaaggtggttngnctttncnangcaanttntncttngccancttactatttcancggncctatgnngaaaaaatcaanttttgccccatgantnanttangnncgttacnccntcncnnggagctcnaggacctgcctgtnangaccagggctgggccttgccaacccanggcaatgttggggccngaggctgctgtgtctgnccaagctnctntcagagtccaattccccangcctacagcgctgtcagcttgcaccctggcattctcacagagctggcttgnccaccccantggggggctatannctcagagaccacttcatcctcntggaatcnacctcttttctaatacccntctttggaaaaaagagcttgncccntnctnnangcaacactnngaagcttntgggccntggtgntgtaataatggtcttnccattnccgttgaaacnncantgcccntggttgntgttntcgtncagntgtcgntgaggnaaccttnggnattgcancntttanggccccaagnntccaaangnatntncantgnaancctnccctataccccncanccccnanttnanntaaaattnnccnnaaaaaccctttnaaatatanaaaaacncanaaacttttgngncctttanaacttttngcg

SEQ ID NO: 4356 - DNA, 913 bp, Homo sapiens
  misc_feature (1)...(913): n = A,T,C or G
cccngcgnnnnncnncacngncngnccgcngnancgnncnnngcgcggnngcngncnnnnnccnnnnnnnnngnnnnagtgcancnatnagctcccggcggacncagnnccagacccnngnggncgagggcgcgngcnaggnacnnnttgnntttcggtntgncccncgagccgagngccggggcanggcggnnagcnccggnccagnggntgtgngcncangngngngcnngcggncgngggcgccctggtcngcgcgggnctacccncggnnggagggagattncgngngngcggncgaggcacantggggccggagnagnanggtgcgcgcncaggggnaanacnggctngtncgcngnggccnggccntctgngccaaggagncccncccnccgagnggggcggnatccnggcccnagccgnttacnagccnnaatcnacnnnggncccagaggcccccggtccccnacntnggcccgaccggnngggncccccgnggggggaatttcnnngaggcnaanancggtnnggnaacccgnncgccccgtcaagagaaccggcncnnacnnccaacagggccnaagnggggcctagtnaaacaaanccccacgcccacccggcggnangggccncgnnngggngttaccntatccngnccgnaagcccggaancggaanggggccntggncaaaaagcnangggttnnnnccccntntggccnnnangggcccnccgngaaactnggggggggggnggngnccccaagtatncggggnaagccctgnagggggggganngtaacccttnnnncctcntaangaaacggggggggncnnncccccccccaagggggggggnggnttnaagggcgancccancnacnctntgctcgnggaannaccccgcgcgg

SEQ ID NO: 4357 - DNA, 745 bp, Homo sapiens
  misc_feature (1)...(745): n = A,T,C or G
tttctaaatgcttggcnactcgntctttctgcaggatccctcgattcgaattcggcacgaggataggccacattccagtaagaactcaatttgtctcccaaatttgcagaaacaaaacgtgatttaaaagctgagctttttatcagaagcttttttgatgttttaagtgttatgtgacttgttgaactttttaaaaagtgctacttttaaaatcccagatactctgaattttagaaaacaaactaattctgattgtgtcgtgcccaagtnccctttttttttaatgaatanggaccaatgccacattgctttttatatttctttcttttttaatgtngccaaaaccaaaagtagctttgntttcctttgtattttgctactttgcagtatttgtgtgtgnggttntttttccttaatttgaaagggacagcactgtgtatgtttataaactaaatgaagatnagatattattttgntaaacattcatctgagaacaatcaangcagtagcccatggngctggctnctttgcagcannaaaccntgnacattttgatgactgtacaacanggaagaactttgaaaaaatcacggtgggattcatattacccaccggntnttcatttcatgggannctttcttgatcaaaaaaaagctnacntccgtaatntnntnatttatcctttctgttntcntaanaaaatatngggttgtttttggtncccanaaatggnaatttttgcnnt

SEQ ID NO: 4358 - DNA, 893 bp, Homo sapiens
  misc_feature (1)...(893): n = A,T,C or G
nnnnaanaananngnncananncannanngnnncnncncnnncannncnnnnngntnannnacgnaanacannnannnagnantccnncnnnnccgcncgcgnnnnnnnnncagnnngcngnagncacnctctttnaaatcncttggcngagntccatgcangnataccacgcagcggnaggacaccnggcgntggggntcnngtagtnnggncacaggnngggncntatggcaganaagnacncagcancnacccagagcgtaatgggnggccganacnggntggggngcacgatnactgtnccaanaaagacggagaactggcagcaactgcangnggcggtggntnncnncnacnacnnattgcnagtcatagcggctatgtgcanattgactggaagagagttgaaaaagangnanataaagcnaaaagacagantaagaaacgagcgaacaaagcancaccngnaancaacacnntaattgangaagcaacagaatngatcaagcagaacatngnganatccagngggatntgnggggaggctnnnagctcggacntgcatctnaaggacaatgaatattcncccanaaacggatncaaactatgaanaacagaagtgggcagccantaaggcagnntctcaaaagncatactcgccaggantctctanggcaaggagaaacaaccnngntggacaattantcaattccaaactntanccattatgccaanctggaagcttggcaaaactagnnatcngctnganaaaccaacctatatggggcatgcggaacccngangnantnccccgngcaaaaacgnnggctancaancgantnagcanaaaanatggcnnncngtnnaagnaaacctngccctaanaaaaccn

SEQ ID NO: 4359 - DNA, 1837 bp, Homo sapiens
  misc_feature (1)...(1837): n = A,T,C or G
cgggtttggggnttttttccnngnntggggggnaaaaaccccccctttttttttnngggggggacanaaagngancntncnctcgnngcncgngcngnnngcgngntgcctnanncgtgggcncgnntgtgtgggngntggncgtantgtncgctncggngcngcacagatgnngcgnngggggnngtnnngnngagncagtnangncngcnagcnnnagtgntnttttttngcnangncggncnanggngagagntgncnnnngngggggggnatggnagcaggngngnngcgggggggngnnggngnnncgngngcgnnaggaggnnggnggggctggnncgggcgnggnnncgcgcncngtnggcccnnnngtnncggngtgggggcnnaggtggncgggggcaggggngttactgntttggcgcgaggngngnccanngcanggnancngagtgngaganngggcggcggnaaggnngtggnancnnngtctngnngncggngnnttnagacgntncnnnnggangagngtgagcgngnnggcngnngagnntgcncacgcagngnnngggagcgagnngctggngangtatgancgnggggcggnntgnnnggcannataggntnnagtgngacangcncnggtcngaggnntnngtnnatngctcgntnnnatggtgnnnngcannangtcgagggncgcgcgctnnaggaagtgtgggggtgtcnctntntgtngggttanggnngagnnctnnntnagagctcgnggnnnngccnnnnagagtcgcnncncgaggtggnncngacgngccacgangtncacgngngtntggtgnaagcatgtnggncgtnacgcatcgtacgcgntnngnngttgncgnnacgcnctnnggggctcgancntnanngcgangganngggggaagggcngcggnccacggtntncnngactggngtgngngaggtctngtgcggtggggntagtgngacntgcagncnntnctcagganagnggngggactggtagctnacagctnngntattnggacggcgngcgannggtgnnantgtgtgncgngngnanggnggncgananantcntcgcggntcntgagacggagctngngagcggnggannggngngagngnngaganntcgtgagcnaggagagggagcaggcgntgnnagcngngagngggtgtgcnnnangtacagtgtgnaggncagagnncgcgantnnggagtnccgcncgtntcggnngctntgacgtgtntntcggtntngggggtngcgtcngtgnnnncngngtntnnnnagggcgngnacgtgnntntgtggggngcatagtatnggcgctnnancnctgtcgcngcgagaggtnagtgngtntgcnncgcagngtggngnagtganggcgggtgtngtgannnggggtgtnncggtnagnggcgngggacgtgntgnganntgcgngnnnaagcacggagcgngngnntcgcgcggcgagacnggagattnngangnngaggcncgngcncncggaggtangcggtcntngaggagcnngnggtatggtngcgcangcgntnttgngcgcntngtgactgggagtncgctntngcgntagagtacananggaatgtnatctntcnggnacgggatgganacgngtggnganagctgcngnctcgagggacanatggcgcgcggtcggnagnagtgngngnagcgcggacgngggtctgagacgcgnnggtggggnnnttnganangtanngncntgngngnggagnnngnntgatgcngggagcggngtatatnatggngnt

SEQ ID NO: 4360 - DNA, 842 bp, Homo sapiens
  misc_feature (1)...(842): n = A,T,C or G
gtnacncccngcntttctaatgcttggcgatcgnactntntgcaggtatcccatcgatnngaatacngcacgaggcgagtcaaantgtntntgnnagcnganctcctnncgggaccngngngcngngntgncnntgatgcnagggtggtcatgtnnnncancaangccntttttgntggccnccnctttgntgaanganggatgtggaagaatgagcttgatncttgtnanntgccnaatnngatggccaanngattgtatagacnctcccatatggtgacanacccagtntcancttaantgaatgtactcannnnncnngnccntcnnnnntcnagncnccttncttngnactntannnntctntatntttatgantacccntantgtggtgcnnncttgaggggganacanatcctatgntcatncccngnnanctacttttggnccnccagatccccatgnttttttccatgcnctgncaacttgnatctnttaaatacatagggggtgnacgngngtataantacnaactcttctngggtgntgnnganaantntgnccangcctgatntcantctcangtgtttagttaaaacnattnnnnatacacctttttttnacccntttattggggtcnaaaaaaaanttncgtcccgntttggaaanntngnttggnccctttttnttngnancaatcccngaaccttngntaaataantanccctcntttgaanatantggannnngcncccttnccntcgtttttggtcgcngggaanaaaaaaaggnctcntttttcntngggattnttnttgggggctcntnggcctttnttttnn

SEQ ID NO: 4361 - DNA, 766 bp, Homo sapiens
  misc_feature (1)...(766): n = A,T,C or G
ggnttnnnncnnnnnnttttnnnagagccggnnnnnngnnnnttnanaatagncaggctacttgttctttttgcaggatcccatcgattcgaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcaattttagtgcagccctnaacgcaccaatagagaagactgacttcggnatcttcaggatgtaactgggaataaaggatgtttctgttggacatgtactgaaaattaacacatgtngtanccttaaaattttagactttctcgacatgaggctggtacn

SEQ ID NO: 4362 - DNA, 746 bp, Homo sapiens
  misc_feature (1)...(746): n = A,T,C or G
tttgaancctttgaaacccttttgcatttgaaacctttgcaannccgctttttgcnggaccccatcgnttcgaattcngcncnanggcaactttnnggaattcntacngttgangactgccanatgaanacctactttcaactnctttttcccccctctagaagaatnaaatcgnatcttttacttacctctggcnaaanaaagaaaaatgaaaanagttcatttattcatnctgattctatntancaaaactgantgncaaaagtgccttcngtccacacacacaaantctgcatgtnttggttggtggntctgtcccctnaagaacaagctacacatcatggntacantataaattctcgatctaccttaangatgaggactccntnnagaancatttgctattgattaatacactgcttnggcnngcnagttnancatncntgcagnntgtctanagaccacanangggccttttgtttaangangaatgatgnttanactnttttnaaaacctataaaatgggnccntttnnactttgttnacantnaaangcataagtnggncnctggncantaccnantatnaaaatgtctancttnggnaagcctcatgaaangngggagngntagaccgtaatactggcccaaaggngngagactttaacttctgtgcacnncctgggncanaccacctgcnnctgcctntatgggttnacgagctnntagacagaagaacagtttgc

SEQ ID NO: 4363 - DNA, 900 bp, Homo sapiens
  misc_feature (1)...(900): n = A,T,C or G
tcttactttctttttngaaacccttttacgcaaggatcccatccgatttcgaattccggcacgagcagagnagccctttcccagnaaagcctggacacccgtgtctttatttngnnagcncgtgctagttgcttttaactggccgacaggtggctggtatttagcccctgaattataaggaaagataggacagaataacaagcaaaaggggtccgatggtctcaccactcaacgctaggcgaaggtctcaccgttcggcgataggcgatagtctcaccgctcggcaattgtctcaccacttggtgataagtgaangtcccttcgtggtcaccaaaatgtgtncagaattggtgggttcttggtctcactgacttcaacaatgaanccacngacactcgnagtgagtgttacagttcttaaaggcagcntgttccggnagtttngttccttcctgattgttccatatgttgtttcannaanttccttcctttctngntngggttccctnggtcttcgccntgggctncaagganatggaaancctgcaaaaccctttcnccggtnaaactgntttaccagcctctttaaaatttaggnccnccatttttggngangtttngntttccntttcccttccccnattngnggccttccnctngggccttctccttnggcccnttccanggtaattnaaaaaccttnnnncaganccttttcnncacttgcnancttgttttnacaaaccttaattnaaaaggccccttggtcngaaccccccaannaagtggaanccnnttnncccaaanaatttaatttngcnaaannaaccaatanntaacccanaccnttntcaccancntgttttcnaaaggggtancccctaatccnnnatttgcncnt

SEQ ID NO: 4364 - DNA, 1565 bp, Homo sapiens
  misc_feature (1)...(1565): n = A,T,C or G
ttttnggnntannnganncgannnnnannctcaacnnggggggnaaaaacncccccacggnnagggccagggggnaanccccaaacngggaaaacccgggaaaannnacggggcnaacggtagggggngggngggggccccgggncnctggggggggggcagaancaaanncaagcanacngggttttttttttttttnanaanngggnccncnacaggggcggnggaaangccacacgngggggggggnggggnagtntgtggtctgaaaaaaggncnnngggggggggggctactnaaaagccangagcnacanganncnagnnaacncgganacangggnacanngcnnnanaggaanccncnncnngagaaggccggnanngccncgagngnagncgcncnacgagnnccaccngcnccaaaacancnnncnaccannangnngncnnnaaanaanangaangcgcaaacanacnnacgcaacgcnanananaannaaagnnngncngaancgnncnncncnaacnncnnacacnancgggnaagannganggnngnncacnaacaacnagngcangngaganaanncagcanngagnnnnagcngacncagnaccncacnacaaagncanaggggnccnacanncnanaaaannanacgnaagncncanacacncaagancnatngaaaaacacnnccccaannancaacaannaggatacccacaagcagannacaccanncnanngccnacnnanacgcccagnangnnacaatagacacnacnagcgnnancanaganaacncncnngctnagnncgaanaannannagnncaagacggacgngaaancgacacaangnnntncacacaaaancncaagnagactagagganncgancacngatacagacaacacacagnacgcnnggcacgagacaannnaagnnnngnaagacgcganacanngacagnannncgcncancgangannnacgngacacnacanagngnnacacatngaagcgacnncagacngagngcnnaagnanangaagcgnacgaannngcananananagacanaacagaggagngagngnaccagcanacacaagnnaaanagagcannnacanaaccnacacgtnnacacccggggcanagngagntnnacncnngaggncacgcgacanagagnaggnacacacacngacaananancgacacagacgngaccnnagacangagagngcacgacaaanacncgnncngcagngacncnccagnacancgcgaacacgacgnngacnngagaaanagaanancaagacanangncnaananacaacaganaagngnagacncanacananagantngngacanatccgacagagacacganaccncaanacngacgcgngannagnnanngagaagnnnnccngcgccgacnnnananngnnacaantcgnaacgangagagcgccggangagangagcacacacaacancacntnnnacnacagcgangaagaganacgngagncnagagacagaat

SEQ ID NO: 4365 - DNA, 1052 bp, Homo sapiens
  misc_feature (1)...(1052): n = A,T,C or G
tncgtgttgtcccttgnnaatccnnaaantnncttgccatcgnannntngcgacncggaggcaccgacttcangcnnggnnaacncnngnngangacnntganngtttttgacagcnnacngnganctngancacgtnngggnngcngnagaaatgcacncncgcncncagnacgctnangnngntacnnnacttgangnanaagnnnaannnaccgccnnaacagaaaacgnnnnggtcngacgccantncaggcnngnanananactganganagananannccngggacgntcnnnncangaanagnnnnnggacatgannacnnnagnanaggcngnnnannnnnacanaancgngnnnanacnnatnngcannnagcnanngcncacctntnacacnaagnnagannaaccgcgcgngantngacccanancaatnanncnnnnngcttcactcnnagngcanacntgnntaagacggnagcancccnncnatcncgacaggccgnnncagagaggnatctctnacgacacctagcgcatacntanncacnanacaggnccgagcagaagatcnctnannancnanntnnatcncncnnanaacatgccgntntnnacccctnnngtcantntgacacannanagtacgataaatgntccagaccgatagagcnanctctcncacgntnngnnggcnngngtagacnccaaagcnacngnancgcatntacgnnnagnnngcntnactncaannnngctnacnccgtacgacagcaccantnnantgngtcgnnnacaacngnngnntggnannntnggnaanngannnccntatgtnnnnncgccntcnnngaantcgaaagctggncntngcnnncgnnnggnncnanccnaannannacnnngtnancngngncgaannnatannagnattnancnttcncgnctanctncacgntnngntgcnacaccagnggnntnncnnnngatnaancnantgangagtccgccgnannnnncnnannnnnagcncnnnancccnnnncc

SEQ ID NO: 4366 - DNA, 714 bp, Homo sapiens
  misc_feature (1)...(714): n = A,T,C or G
gntctctattnnaatcgcttggctactcgttctttctgcaggatcccatcgattcgaattcggcacgagagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacataaggccattgcctggaagccccagagctttcctctgtttgtatggcccgttcatgtcccaggcattgcaacacaaactcaagatttcaccacaacatgacaagcattttcctactgatattag

SEQ ID NO: 4367 - DNA, 685 bp, Homo sapiens
  misc_feature (1)...(685): n = A,T,C or G
gcctcacgctnntgtactttngttgctgtgttgctgtgctgtgtgccnctnngatntgacnactacacnnnncnaaggtgcccngcctcctncnngatngtngnaagnatacttgacatatggagnngcattngnctcngccnangtgaaanngattggantnatncnnatgcggggttggaaaanacntgnnggggnnatatactgtgacngtccgccacataaatcggtngccatatgaactatngaaggctggttaangacntannctggctacnanatngctgatgtanatgnncnanntgngnnacatanatctggntgtcaacgnatatnnnaatntcnnggnacngngaactnatnctggngtgcncacagagctctcnngatttacttatcactatnanatatggggtantgcggaactctangcanntantgcttcacntnatnttgnaaaancatatggcatnntcantttgcttgtaaagcacttcattcttaactgctcctnaggannggtnttccncncaanggnatntnaaaaancagntttgnttccttngntggcgnaccnantnnttgnganntcttccccagngnannanaaggttacttnaggttccanncctcnttntaanncnttataatgaatnnncnctnaaanaaaannnaanntnnctnt

SEQ ID NO: 4368 - DNA, 720 bp, Homo sapiens
  misc_feature (1)...(720): n = A,T,C or G
tccttttcanttcactnncttttgttctttttgcaggatcccatcgattcggtgggaactggctcaggctggattactcttgctgctgtcttgctgtnctgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcnacaccatatcatggggagcnagaagaaaaggtgttccttcccatggatatttgtatgctgcatggtgtttcacaagangactttttaccggaggaaccaagntnaaaatgtgagagatgtaattatatgacattgccagtcaaagcccacttgccctaaagcatgctagncctt

SEQ ID NO: 4369 - DNA, 808 bp, Homo sapiens
  misc_feature (1)...(808): n = A,T,C or G
ttanttncatcagctcttgttctttttgcaggatccctcgattcgaattcggcacgaggttttnnttttttttttttttttttttttttnggggtacggnagcacttttatttttccttacacaatgacgtgttgctggggcctaatgttctcacataacagtagaaaaccaaaatttgttgtcatntnttcaaagaatcgagaattgngtacaaaaaaaaccttacataaattaagaatgaatacatttacaggcgtaaatgcaaaccgcttccaactnaaagcaagtaacagcccacggtgttntggccaaagacatnagctaanaaaggaaactgggtcctacggnttggactttncaaccctgacagacccgcaagacaaaacaactggttcttgccagcctctaaagaaatcccagaacactcagccctgacacgttaataccctgcacagatcanaggctggtggcccacagactcaccaagccacagacttgtntttcacaagcacgttnttaccttagccacgaagtgccaagccacacgttctaaagggtgaactcaaagatatgtacagggtnttaaacaaatccaaggggaacagttaacttcaatacaaggncaaaatcagcacaaggtntacaatncagngctgatttaaatacaagctttaanggcaatttntttttgaangntttttccatttcgngaggntngccatgangngggtgcattttgncnnggggcaaatttntnttttcaattaanccatgccagaaaangctccncatttgntgggtccgttn

SEQ ID NO: 4370 - DNA, 726 bp, Homo sapiens
  misc_feature (1)...(726): n = A,T,C or G
ggnttttaagatcagctacttgttctttttgcaggatcccatcgattcgccagtccatgggcaattggcagatcaagcgccagaatggagatgatcccttgctgacttaccggttcccaccaaagttcaccctgaaggctgggcangtggtgacgatctgggctgnaggagctggggccacccacagcccccctaccgacctggtgtggaaggcacagaacacctgnggctgcgggaacagcctgcgtacggctctcatcaactccactggggaagaagtggccatgcgcaagctggtgcgctcagtgactgtngntgaggacgacgaggatgaggatggagatgacctgctccatcaccaccacggctcccactgcagcagctcgggggaccccgctgagtacaacctgcgctcgcgcaccgtgctgtgcgggacctgcgggcagnctgccgacaaggcatctgccagcggctcaggagcccaaggtgggcggacccatctcctctggctcttctgccttcagtgtcacggtcacttcgcanctaccgcantgtggggggcanatgggggtngcagctncgggacaatctggttacccgtcctactctggcaactccagcccngaacccaacccccanaactgcagcatcatgttaatctgggacctgncaggcaggggtgggggtganncannananntnnnangnaaatttnncttttaaant

SEQ ID NO: 4371 - DNA, 767 bp, Homo sapiens
  misc_feature (1)...(767): n = A,T,C or G
tgggggttttatanncagctcttggctttngcngttnnagaganngctactngnnctnnagncgagctctacatncanaactnatcaatgctgatgtggctaaatacctagccttttacatgnctgccccttccaggctcacatcattttatttcttttttctttgtctggtggttttttntttttgaggcaggagaattgcttgaacccaagaggcggaggttgtggtgagccgagattgnaccttngtactccagcctgggcaacgagcaaaaaactctgtctcaaaaaaanaaacttgcacntgatnaaaaanggtnttcatgacnnagcatgcncattnnctggcggacatttccngaancagaccctgttantccttnnacttacctgctggatttttnaagcgctaaatttataacttntttgaaacaannactngtgtaattntnccatttgggggcaaactntattcntgtgancattattnaatcttggntgtnaatntattgananccccttaatanttgcaatgggtcaaganaagctgccacggngtnatnatcctctttanattgggcntccantattantgatgcantcatgacttntggtttnacntgtntgggatggggccaataaatgnatncttcaagcnngncaaaaaaaancccnggattttgattcnnanngggnacntggnngtttnctgacttttaccntaaattaccttngtntggntcttcatttaaaaaanaaacgcntnt

SEQ ID NO: 4372 - DNA, 830 bp, Homo sapiens; identical to SEQ ID NO: 4332
  misc_feature (1)...(830): n = A,T,C or G

SEQ ID NO: 4373 - DNA, 733 bp, Homo sapiens
  misc_feature (1)...(733): n = A,T,C or G
gtnntttcaaanntnaggctcttgttctttttgcaggatcccatcgattcgaattcggcacgaggtctcgagtttttttttttttttttttttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactggctcttgacaaaactcttgaggncttcaagaaaagtaatgtactcctggtgctccagggctgtgctgagctccaccagctcatctgcaaaagtgttgtccacccctcggtcggcaaggaaatccattangtggtcatataaggcccagtccaaggaatctgtgttgagtgtataattagtatccttccattcagactcgccagtggactgaaagctaacttccctgatagagaagatgtcctctcagcctcgcttcttgtccacctcatcctctggataatgaccgtccacacaagggcccttttgccatcatcattctttataacttcacccccgaaatttgggaagttgatgtcagttcaggctcctgnncttcaaccttctggccttgncgangg

SEQ ID NO: 4374 - DNA, 779 bp, Homo sapiens
  misc_feature (1)...(779): n = A,T,C or G
tcacagttttttcntccccgaancgttngaaaattcctgcaggatcccatcgattcggtggaactggctcaggctggattactcttgctgctgtcttgctgttctgnatgccactgggatctgaacactaaacattgctaagaaacccacccaccaccaggatntttggaagtaactgcacatatggaaaagtaaaagactcantctctgagaaaacaataggactgatgcgaatgcagnnatggaaanaaactgtgnaagatatatactgtgacaatccaccacatcagcctgaggccatngcactatggaaggctgntaaaagacataatctgactaaaacgatggctttntgaaaatcgtcnnattaaanggaanaaananantctnggatgacaaaancatatcgtaattatcaanggaactggaaaanttatgctgaaaacacacaganctntcttctttacttaacactagaaatatanggtataaaggatcttcatgcanatcatgctgcaagccatattgcaaaagnacaaggcnntgtcacttgcttgganagcaacnccatattcatgngnagncanaattaaaggggctncnttcctnatggaatattccgtatgctccnattggggcttncncaatgaangacntttttntncnggatgnaacccanctatnnnaanntggtntacaacannntatatnntttnnaacntttnncccnnccananccnacncnttggccnctctaaaaagnantgcttctngtcccg

SEQ ID NO: 4375 - DNA, 1165 bp, Homo sapiens
  misc_feature (1)...(1165): n = A,T,C or G
annaaancacacnnnccacancaanaaanacanncanananncnannaaacacaanacnaaccncncnnncncncnacaaacnnncacanncnncancncncncaannngcgngcttcaacnnatggnaagccctnggcnacacgnannaacagcncgnaancnacgcnacgcnccnanncngannnaanacacccanannacacgagagagnnancnaacacnannanacnnacccgcnccnanaaancnggnccnngacgangccgacgnacacanccacaaaacncgacaaccccnaacaaaangcaaaacgcgnaaaganccnangacnannaaaaagncgccanganancaacnagnacacacggacnaaccngnaccngcanacancnnnccacaaaccncgagagcnaccccnacgcagcancncnnccgcaaanngnnanncnacacnccnagccccagannangaacccagcanccnnaancannnngcncnacgaacaacaacnnananannaacccccagacncacacaaccagnnnccnacgnganacgncnacccncaccncacnggaacaananaaccaggccncnaanagcgnnaacaacccaaaaagnacccccccncanacancaacagnanacacacacccncncgggacaancanacncacnnaggaaaaccccaannggngncaaatnanancccccacaacacagcaccaaaangccaancnccaaaacaaggcgnaacnacnncagccgcgacgacacaaacaccacnnaancnnaancannnnncagggncaaacanngcaaaanngnnggcgacacactanancngngacaccccaananaatnagccccanggancgacacannaacagcgagccgaanccggnaaanaaacgnaaaaaccnggcncaccnaccaggcacnaccncaacaccacngcaaaaaaccancncccnaatcnaaacaccccaagaanngncacacacngnncacaaangnacccncnnaanaagggccaanngccccangaaccccccacancnnnnccncangaanaanaggncccnacncanggccnacnncaangacacacnaccccaagaanncaccacagcnaganaancancaccccancanngaanc

SEQ ID NO: 4376 - DNA, 725 bp, Homo sapiens
  misc_feature (1)...(725): n = A,T,C or G
tttnacactttngcnacttgttctttttgcaggatcccatcgattcgaattcggcacgaggttttttttttttttttttcacgcttaattcactttatttttcttgtataaaaaccctatgttgtagccacagctggagcctgagtccgctgcacggagactctggtgtgggtcttgacgaggtggtcagtgaactcctgatagggagacttggtgaatacagtctccttccagaggtcgggggtcaggtagctgtaggtcttagaaatggcatcaaaggtggccttggcgaagttgcccagggtggcantgcagccccgggctgaggtgtancagtcatngataccagccatcatgagcagcttcttaggcacaggtgcggagacgatgccagtgcccctgggtgcagggatgaggcgtaccagcacanagccgcagcggcctgtcaccttgcaagggacagtgtggggnttgccgatcttgttcccccagtagcctctgcgcacggggacgatggagagcttggccaggatgatggccccacngatggcggtggncacctcctgggagccacttaacacccanaccgacttnggccaaaanggccttaaaccggtaaaaaggccnctttnnttgccgtttttnccnataggnttcntgcccccntgnacangctttnacaaaaaatctgnnntttatttanaaggtgggnnaacccccccnng

SEQ ID NO: 4377 - DNA, 725 bp, Homo sapiens; identical to SEQ ID NO: 4376
  misc_feature (1)...(725): n = A,T,C or G

SEQ ID NO: 4378 - DNA, 1050 bp, Homo sapiens
  misc_feature (1)...(1050): n = A,T,C or G
nngnnncccnnnnnnannnacgnngcgccnacncncgnnngnangcgccccnncgcacccganangnacncnnncagnggcntncnncanangacggnggnnnnnncacannacncncggnacgnngncnccgangnnnngccgncncngcnnncnccggngccccnttngaaacnctngggaaatccgacacnccnctcgngancagccanacccnnaccgnccggggangcnnaaancnncacggcanngngncgngnanacnancncggnnncgcnnggnccngacacgnacgncgcccnccngncccngncggcgncangngaaagggngccgnggcccngncgnncnacncncgccagnnannccngnncgcnngcacngnncccngccgccnccnnncgtcnccacncnncgcgnnanccngcncggncagntncgcagagcnangcccgcgaagaaaaccgcnngcgnngcgccccacnggcgacnacgccagcncnccnngcntagnggncanacnnanccgngcggnngngncnnncannngacanangcgcaccacggcggcnaggccnaggacgaannggcgacccngcgagccnangannanccggnatngccanaaccncaacggcnncngnnacgcgnnacngggncnaatncaatcgcnnganangacacancagnagcgcctgcnnncgcnnanncgnnacactcacacnncaccngnggccctcaagngagccgccantngcgngnnncaaagcangcannggaccatannngnaacaggcacaanggcantcgcacnanggcnncgngganncaccccnatagcnacgggggagcangaaccaaggggcggncccgtcccnanggcnnaagtcggncaggctgcacnggncggncncannaagacggnacnnnngnncaccgggagggacccaccgcnccncacngggggnnncnanggncnccacagggnacngnncgccnnncccnnagncccncangggnacccgnaanggnaaggcntgggggccccg

SEQ ID NO: 4379 - DNA, 731 bp, Homo sapiens
  misc_feature (1)...(731): n = A,T,C or G
tntcaatnctnggctctcgttcttttgcaggatccctcgattcgaattcggcacgaggtattcagcttggctggagcagaggcaggagtggggaactggggacnggtganactagaggttggcngaaaccagccatagtagtttttgcctcatttggacaacaaggagccatccaagagagagcggtgaagctgatggtgacacagccatggcgcattgaaatacccccagtggctgtgttgtagggtatattgggttggggagggacaaggtcaggaggcatagactcgacatcatctgatgtgattcaggacagaatggcgagcctgaagtgaagtgtctgtaggataagttggaaaggaaggaaccaatatgagatattaaagaagtgaaagctataggtcccagtgccttaataaaggtaaggagtaagagaagattcgagattgactcccagactctccagtctgctggacatgggagatggaatagaagttgatctcggtgtggtcanaggagagcagttnctgtgttgagcatggatagcctgcgntccccaagagaangagttccagctgncttgtaataagccaangcnnattatggngnagatccacccttgggagcnacttccttagggggccnacncttnntagcccnttanttaannanttcccccccctanatnnttccttnggntttaaanctngnaaacttntntttacnntttc

SEQ ID NO: 4380 - DNA, 731 bp, Homo sapiens; identical to SEQ ID NO: 4379
  misc_feature (1)...(731): n = A,T,C or G

SEQ ID NO: 4381 - DNA, 890 bp, Homo sapiens
  misc_feature (1)...(890): n = A,T,C or G
cnttcttnannnnatnttcgaagnnncnnnnnncntntnagttnncnnnnntccngttctaatgcttggctancnnggcgctcnaacgcnctttcaaaccnagctctngntcttttgcaggncccatcgntcgaatcggcacgaggctgnttcctcaagaaaatgaagagggnaggatggctcagggaaagttnatcagagggnaaatgtcactctgtaaagagtaaaaaatttaggatgatgatncngatctgggaaaaaaaggcatagtgaagaccacttaaaaacaaacaataaaacctatgaaggtgcatgctatttccccanagctaaaaagataagtgaaattgtgttttgaactcttaagtggaggtgaagcacaatttattagccaccaaccacataagtgattatgaagtaactgagaaacaggtnacattttttcccacatggacaaaactttctctttctagaatattaagtatctatgatnagaaatgaagtagcatctcaagcagtttataaatctaccagaatattagaatcacctgggacctttgaacgtactcatgcccnatngnctacctntattcatttntttttttcgtaagatattggggacttcaacttcnggncttaaaangatccntcccacctccggccctcctaaaagttgtnagggattntcaaggccntgagcccncntgtgggcnctgcccttctnatggtcntgcttttngacccaatttanatnnaatcatcttgngnggttggnnccnctgggcctntaaagnatnttttaaaaanttntccnaanggggncnactnaatttcttatcctatcgatttgtnnancccncnggcctaatnccttgnnnatctctttncct

SEQ ID NO: 4382 - DNA, 789 bp, Homo sapiens
  misc_feature (1)...(789): n = A,T,C or G
gggggtanganccctttganaccnattgctacttgttctttttgcaggatcccatcgattcgaattcggcacgaggaaggatccagcattcggaggcaaacatgaagctccatcctctccaatttcggggcaaccatgtggagatgatcaaaatgcttcaccttcaaaactctcaaagggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggccaaaagttgaactgccactgtataaccagccatcagataccaaggtgtccatgagaacatcaagacaaaccaggtgatgaggaaaaaactcattttattttttaaaagaaggaaatcatgccagaaaacaaagggaaccaaaaaaatctggccaccgttattgatcagctcatgggangcattgggaagaaaaaaagtgggncagaanttgaaaaataatccttcnggagggaaaagcttaaaggaaagccaaaancaagggggaattncttttgnaaaagccagtttttccagaaaanttcggaaaaaccnanggaggaaccagccanggaaaaagatttttcancccgaaatttggggccannaangg

SEQ ID NO: 4383 - DNA, 1266 bp, Homo sapiens
  misc_feature (1)...(1266): n = A,T,C or G
angntttncncccctttttttntgaaaaacccccccttttcgnanaactnccccngtctncctgatnntngcgangnnntacgcccatatgggatttctgtaattnnnggcctaccggcagnagangattatngntatagnaaaantttgtggtattgtntctcntgtcatccgnctggcncannnatctgtnganaancncnnnnntnttgggttacatnccanntctnagttnaacgctgtaaatcntngagatnncgtgngnacgacancngcctctntcatggctcnnatnacttcnaccanaanatagtatangnngcnnntttgagcagnnccccnatcntncnacgacnantcgctaanangcttctacgattcnntttttgtnnnactngtncctttannatccttnncnnntaangccnanttgtngnanactancgcactntgcaaaatngntanttnttctaactttnataaaatgnnagtgcnaatacngntttcannnttannnnatanaaaaaggaantngantcntgtntctncccctttcangtanangnncncctagnnngattcnntnngtnanntattcttatancgcgnggtagaaangcctactttgtgngtannatttctcttctattnatnnngttcctctgttntacntnnntgaancnntttagnangaaggacngnanaaacannaccnacngcnnnaggntnttnnngcntanaatanngantacttctnangnccnnttcactttcnatagnaaccctccgtntgtgagncctttctanttctnatacnaatactctttngatncgccacanttntnnntanntntnnnntttnntnagtnnatgttnnnccagcannttctcnntncctttctnnnacnaantntgnaaannngctttcttnnnnacntagtngnannnatcaanccctntncnctgtgcgtcntnanatattncnnntcttantcnnncnncntanatcgnggcntanataccnactnanntataatatgngnnctngtcgntnatttncaggcattctctgngntncntntcttatcnccntcgtntcgtgtncnngctagnnntantantancgtnanncatntcagtatacnntctntcntgtgngngcatacnctannaatntactgntnctcacnngcntgacntacgntangantngaanggagtgcccgnnnntgcnaatntatctcncgcacctntaccnactntncn

SEQ ID NO: 4384 - DNA, 785 bp, Homo sapiens
  misc_feature (1)...(785): n = A,T,C or G
aggggtnnnnnnnnnnttttgaaaggcggtnnnannnnttnnnaatatnagctacttgttctttttgcaggatcccatcgattcgaattcnncncgagcngggncgnangnagccatggtgcccagccgnaatggcatggncttgaanccccacttccacagngnctngcagcngcncntggcnncntggctcaacnagtcgntcctggaagaatccgnanacgtatgggcnggacaagtcnaggcgcaccgcatngattgacacgccnnntgtcgggatcccatgngggtcattttgcncatgncncanggttcgntgcnacacanaggtgctcagccgagcnnggatntagnctggaggagcttagggtgnccggnnttcacannanngtggtccggnccattgncntttgtgtngatnngnagaggcanatcangnccanngnttcnctgcatgccaacgtgcagcggntgaaagantccgattcanactgatnctcttcnccncgaagnnttcngtncctanaacggagacanttntgnttaaagaactgatacttgtcanncngctggaccggancgnttatgcncttcctggaacgtnttnnnnaagganaaaactntaattaatactttgggaanagaanaatttnanagccttcnatangtttcganttggtccgtgccaannggcccggtttttttnacctnactnnccaanangancccaagggaagcccttncaacanggatngtnaaaagaanaanattaancnccntncntg

SEQ ID NO: 4385 - DNA, 967 bp, Homo sapiens; identical to SEQ ID NO: 4330
  misc_feature (1)...(967): n = A,T,C or G

SEQ ID NO: 4386 - DNA, 1118 bp, Homo sapiens
  misc_feature (1)...(1118): n = A,T,C or G
tnggctttnaatnccttttcnattccaatgcttggnnactttcaacacgatcccatcgattccgaattccgggcacgaagcaggagctgtgatctgcccccaggtattctgacccccaaactggctctcaacccatgtttacatggatggaaaanggaanagggtgactggtngtatcaagctcttaaagggccttacttttgggtggaaaatggggaccctaaaaatttganttggcttacttgganttnccttnctggtcaattactggaaaaatttgggcaccttcanttaantttaaatnctttttggaaactttttaccattaaaccttggnncctttaaannntanntatttngnccaattgnangaaantnttatctcttnnattattcattaaaaatantnttnccnnnagtctccnatctcttttgntaataagngncccggnatnctcaantntacnatatgtnnaagtnntnagtcttnacanccagattntnttnttnanttataanttgntnanancgnttnanntannntatnngnnaacttcntactggtccaangnntgtnngaatgttcananttaactantgnantnttngaaantacaactnggtnntancaaancntcggnannngtggncanttatncnnnngnanaatgnnaaatgnngnantcgcangnttccnangnntctananccnnnaatctcnangcgnanncanttcatnnncggttacctccnatnagtnacctcncgnangntatatgnagncatgntcttntgttagcaattgaanncatcnnncnatcnagantccanatantaatcttnncgntaancncgcttnanngacgcnttgntatcccnntcgngatgttatatntacatnnatacannntgnntganaaaatacngtncngntcnngganaatctnagctggtnctcacagnatcntancgtgnaatnaccntanattgtncncccncgcggngtgtcccanantcgccnntagagcntcatntcnngnnattngacggtaatnctgatatnttntctcacncagattncnnctaataaaagngnnntatttgtagaaatgacnccg

SEQ ID NO: 4387 - DNA, 486 bp, Homo sapiens
  misc_feature (1)...(486): n = A,T,C or G
cgccttttaagctncttgttctttttgcaggatcccatcgattcgaattcggcacgagactctggcacagccagagtcattgttctttcaagcagtcattcatatcagcgggntgccattnctgntttggagcactagnnnaaaatagctgcactatccggngcgnntatncnaagctgcncgcnngnggcttgcnttcttgngggngnttttnttgnnaatntcaaaagtttctaatcctnatgccnctttttgggnaaanncaagannaagtcaatcctncccttggggatccngngttccccnttcaatcacgatttgtnggnnntcacncgatttatntttacnangacacaggnttattgancngttangttnttaacatctngnaanctnaantgtngctgnatgnaatgngcctnnncanttcccatnacntttgcccctncnngnggngccctancgtngtgngnntnaatgccnnan

SEQ ID NO: 4388 - DNA, 842 bp, Homo sapiens
  misc_feature (1)...(842): n = A,T,C or G
tcncctttngaaatcnccttggatnttgctttcnaatnnctggctcttgntctttgngcangaatccnncacgaggganngctgtcnganantctgttntanacggnaannccctgaattnancatcnacagtgctnntcttngaancannnntnctaaantcnntcatganatggaggtgattaagatggcccttgctcntggatgncanacttnngncagaatnnacctactntgaccataggatacttttntntgtaggtgtaaatggttctnctntactaatcngannnggannatannnatacaacnttntangggatccntanncanntnggaacagcngtngatgnccnctttnggagggtattcatntnncantcntgatnaaanntncctnattnttntnnctactgangcaacnnntgcannaagtgtatgaanggtgccccctgtnccaatgatnctgcantgctgnatncagccttttctgggagcaccggtccaagcgttccggaattgattatcccnatcatttntganntgtnactggaaaatntnngnctnatgcantnaaaaatgtacttggcttgctttttnncaanngnttatttncntctttgggaagtaataaaaccgattcnacccgtngaaaccgttaaccaaaatttcntggtattttaaggnctttttttcctgttntganggtcggagtcnttggnnccnanntatttttttggggtttttgngnaagaatttcctaaaantaaanntttnntnctacccatttttnananataaantganntaanaaaaatttcctgcccttttnaaaactttnt

SEQ ID NO: 4389 - DNA, 628 bp, Homo sapiens
  misc_feature (1)...(628): n = A,T,C or G
nnnnntannnnntcntnnnnanntntanngatnntntnttcnnnncnnatnttannattnnnannctcnnnnnntantatannagnnnnnnntatntnangantnnnnnnnnnnnatnannanatnnnnnnnncnnnnnnnntntttcattttngaaacncccttaccgtgccgcnttngccagtatcccatcgnnncgcaacnacccctacnnaaaaactntaaanaaantggctagcaacgggttntttcatcncggtgtctcttnatntaagtttnctaagttaagaaaagctggtgacatattnatacgtntttgtgcaaaaataaatgaatggcantagnacctaaaaanatctntattatgtacttntgtgtgaaaaagtntgtataatanttccctnaaatatgcattattttacttgtgagttntttnctgaattaatctgaaatgtncaagccctggattngctacagagtgagaagttatngctattngtttcttatttgtaatgcttggaaatgctgcacaaatcacgaagctcttaccatgggttgaacaaaaaaaggggaaatggggaggggaaaagggtgggatagcccagcatgcttgtntggtatattccag

SEQ ID NO: 4390 - DNA, 676 bp, Homo sapiens
  misc_feature (1)...(676): n = A,T,C or G
atncttggctcttggtcttttgcaggatccctcgattcgaattcggcacgaggagttttttttttttttttttttttttcatttttataaaaatgtgttttattgttttaaaacaagtctataaaagtagaaatcacatncaaaaatacagattactctgacatgttggcaaaatagcttatggctggacttgagtttggaagttctgtatgtttgagggcatccgatgtcagagtccaaccggatcctaaccccagctcttgtcactaatagtaaagtttcaggtattatatcatagcaccgactgagtgataggtgttggaggtagttgagctggaaaaattcctgaaagcagtcattctttagcatgacactatcacttaagtctagatggacaagattggggcatcttctaactaaagtagagagatctgatttctggagattctttctgtagcccgctaagattcagctggggtgatggtctctgacacatgcgcaacagcacctgtcatgcttttcaagtggaatcaaacaccaggagaggtcactatccagctggacagttgntnccaannntgcaggcaatcaggaatccgacccccaaaggtaatcccctaattgagttttgcanagnttgcatggacccaaaccgagcttcagcttaatntgactg

SEQ ID NO: 4391 - DNA, 946 bp, Homo sapiens
  misc_feature (1)...(946): n = A,T,C or G
ttctaatgcttggctctcgnncttctgcaggatccctcgttcgaattcggcacgaggntgtcacangnnnnntgtntccacaggcaccactngctangtctnacctgtgntgnctgttncaacncggggctangnangctngtattccacntggataactaanccntggtcataccgnccntgnacgtggnaccngctncnaggagatgcaacnanacattctaagatgcttatgatccttacntgtatctttcntnttggngattcttttanattggatgttgcaatggagntgaatnancttnnnnncngctctnntnannnccnnttnnatangnannaactttncnnnnnactaaatngnccactnatactaatgtgcttagatgcatatnttaccctcttnaagtgntaaaaccctttagaatccnaaggaccagngtcaancgcaacanncttctaggacctatgcgaagctntgacttganccttgggggatcccntgngngttanctcngatnatgtttcgnggaccngcntngacncatntanagtnttgcnncattggnangnccctgttaaatccccaantnggaaanccnnttaggggttttanangcttnnggaaccccnnccccgggntctttgttgncccccgatatgnggggnnaaaaccggtttcaaaaaaagntcnaactttggggttnantttaaaattttnggggncccttttggangtaaccctgngnaaggtgcatanatattgggccgggaantttnttnggtggggggccanccttnggngggctnncatttanaaatggcttaaanaaaantttaaccnccaannantcnnatnnncnanaaacnncnttccngnacaanactcccttnnaaancnnccnnntcnaatggtcaaaaantnttcaaggancnggnttanaan

SEQ ID NO: 4392 - DNA, 721 bp, Homo sapiens
  misc_feature (1)...(721): n = A,T,C or G
caaatcnntggctcttgttctttttgcaggatcccatcgattcgaattcggcacgaggttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattctgcagagtgatatgaatcancacttctttgaaggagacttctgggaagcaacccngatcatttccgcaccttnagccncatttagaactttgacnattaaaacccccagtgggaaatttgaaccagatgggtgatananctgccacttttgaaaagacaagtctttgggtcaantcnccancngaccngntnccgtaaaaatccaaagctttnnggaaagaagaattnttnnaaattcttagggnttccaacc

SEQ ID NO: 4393 - DNA, 1102 bp, Homo sapiens
  misc_feature (1)...(1102): n = A,T,C or G
gggggggngnnnggggggngnnggnncnggggggncnggagggggnnnnngggcaggnggagggtnaanccggtnnggncnnngnncnncctagngaacccttggaaanncccgnagcaggnccaacgaagcgaaggcggcacgagaagnggaccaacgggccancnggcnnggttnntggggccaagacgggggancnccncnnggcnggggggggnaaggaggggcgnnccnggggggnagggnaaaaaaancnccngagngggnaaagggannngggggnangggggncgngggaaccnnagaggaaganaaggggggcgggcnananggggngnanaggggnnagggggggnncngnncgcncggganngannnnnngaggagacgcccgngggggnaggggaaagcagaagggggnngcngnncanggggggancangggggngacncccggangggccnggagggggcgnaaaacngnggggccccngggnggnccngggggagnngagancggaagngganannncagnaaggaggngngnncgnggngggggggnnnaaagnncagggagcccngnnngnnaggnngccnngggggccnggggganagggccgacnagnggggggncangngnnggggggnggnngcgnnnngngcaggnggcgangcangggnngacggngggaggcacgngggngnanggggggcgaggcngnggnggagngncgcgaggnngannggggggggggngaagggngncgggggnancnggggggngngggnnagggnggggngcgnnggggcggcggcnaggnnggnngnnggggaggggaggannggggcgggaggngnnccgnnnggcgganngnngangngcggganggnngcgcaggcgngnggggncgcgggnggnngngggannggggngagngggcgnnggggcggancggggngcnggagangaggaggnngnngnngggggnggcgggnggngcngagagggnggncacanaancgcgggngggnggngcgggccgggggganagnngggggaggnagnggnggangcgcgagggnngggngggaggggngncg

SEQ ID NO: 4394 - DNA, 762 bp, Homo sapiens
  misc_feature (1)...(762): n = A,T,C or G
cnacangngacnggnnntggnactcgctctttcccnggcatccctgnagacanagatgnnnaaggggaagangntngaaaaccaggntaaaantttttangagaaaggcagaggatgctcaagggnaannaganggaaatnnagntnaccncnntnncggnantggncnntatgnnnaanncnncgnataannngntctntntgnngaagacagatcccagccttggatggcttgatagncgatggatggaaancgatnngggncattttaaanaggcctnnangttacattcnnagnatatnnntaagagatagngnatncaaactntgatgaangtggtgatgcaggactgaagcatggtccactacaatgaanctttnttccnntnggncaanggnatggntgatgatcccatcncagaggatgntnctgnaccagaggngcctcccattntcgctncnaactgccctaactancccatantgagntaacatgtcccttcatnttgttacgtctatnnagacaaatgctttntctttnncttgcttgacccnatcttgncttnccnttcagntaantnnagaacacattnttancnntcnntggccatannggttctaacttnaaaccattttacctnttaaattttgtgattatagtnngtggnnntncntaagggnaanaagattgcctttcaacttttgngaggggaatttcgngnttgngtaaantnattttgtccaaatcttttgaatttttan

SEQ ID NO: 4395 - DNA, 578 bp, Homo sapiens
  misc_feature (1)...(578): n = A,T,C or G
gcncgncgaannannacgngnnanngcccggnngaannangcncnnngannnccgaaannaagangnnnnnnannnnnncnnnnnnnnnnnnnnaaaccttgaaanccgccgnnngnnggncnctcggtatcgcanaanacacaanggggaggaagggnngncaanncgggttggggtgnaaggggaaaaggacacgaacnnnggntaanggnagcaaganttacacgggcganggganccgagccngtcccctttggagannatccccnanaaaanatnganagnggncnggnggggngnnacaggacacgaccgcggnnaancnnggaantggccttnngccggcaantccagaactaangggggnncaangcagggagnnnacaangncgnnngangnggcagnnnagccagagananntgacagaagagncngggcngtgcgggcanccngnagaaaannngccananccaggaggcccgnacntggngnaacccacgnaaccncnggaggncagaggnganaggaacacnggggngnnggancaggagggcnngagggnnacaaggnanagcn

SEQ ID NO: 4396 - DNA, 898 bp, Homo sapiens
  misc_feature (1)...(898): n = A,T,C or G
tnncctttctaatgccttggatagttgcttncnatngctggctacttgntcttntgtaggatcccgngcnngatnnttatgactgnnccnntnnnggcngatcntttgcnngnttacnctngtanaccngtngcngcggncgnnngaagncgtcctgggaancagataanacngctgcnnggctnggagtgnncacccggtacacantntttatttannnggccanctnccactgatgaacatatantcngagtgactgctgaaatagcctttttggattgaacgcccacgacagtncattangtntcncttntatcatgctttctntactgnnatgagcttcactgaacggcgtgaaaaacttggaanatnnatnggacatgctgtaanatnggacatanatttttatacggaaaacttnaagtgcncacagttgaaagccataatggcatcccatagagaggctnttttgaactttgggatgctttattgnnccaaagaaagatncagatttacctgaaancttgtgggtttnggacacctttntgntttntaagcctnntgaacaantttttaanacntttgacnttttnnaaaaacnttgncttaccnagnggtnacnanngaanaatggccnttcangggaaatttctccngggntttccccnggaaaaaananttncnnnccagggttttttggaggggattccaaagtnttttntaanancnggggggtttncnaaaaaaaatgggggcnncaatnggnttttaganggggaacaaaaccnntcnnaagcccttttnntcnaantntcnncctttngtaaaangncttccanattatttcttttnnctangggttttctttttttgnaaaanaaaaatannncttttttnt

SEQ ID NO: 4397 - DNA, 769 bp, Homo sapiens
  misc_feature (1)...(769): n = A,T,C or G
gcttacccctttctattncttggatgctcttncattgtgcangatcccancnntcnaattcggcacgagcagagctgtgatctgcccccatgtattctgacccccaaactggctctcaaccatgttnacatgatgaaaagaagaggtgactgttgtatcagctctaaaggcctcactttnggtgaaatgggacctaaattngatngcntacttnattncttgcngtcnatactganntnggcactttataatttnaatactattgaactttcaccatanccctgtcctataaagttgacttgcaaatgangaaactctatctcttcaatattatgnactatatccaagagtcacaactagtgagaaaaggacangntctaactaccaatgngaggctgtgtcttcacaccaattcaacagagtatcttgtaaatgntgagaggagaggtactttaagtcatgggtgtctatcatangtgcttnacaaaacnnnttgacaactgattgggccttgaggtatgaatgganttagccaggcnattnaattcgaaatncgaagcttcaangacagatttantaacnctttgngagnagttgaaatgcagcaagatgttacgacaanttgntactgnnccatgggaattttaccaaagttgtgnaattgnagnnaantgctnatggaaaccttgaaaggatntngctttgnggcncacgcttgaacnaangncttcggantgcntannaaaaagcccnaatgcnnntccancnn

SEQ ID NO: 4398 - DNA, 1466 bp, Homo sapiens
  misc_feature (1)...(1466): n = A,T,C or G
cnncntcaatnanntanntnnnancanttacactncanccnctataatnaatacatatcgggggatnttatctcncctccantancnttntactnctccccattatntctnttcnccatacatattctnntaanctnnatntanatcttcaantataatancnacccaatctatnactacnnntacttnaantctccactnttncgncntnccannccnntnatattatnccnattnaatcttnnccnccnttanacctcttcntttacnttaaactcatanctcattntnaanannatcntcnttctnatctcaaatcnnntcnnnaacttcatttctatttnnatacttttcncnataancttcanttatnaatcaanatnnnctttntnntanctcntntnatntnncattntcctnccantantanctntnttaanacattcncntntctatcacnnctnaacctatntanttntacnttntatctctnctntctntcctactcactatacnctcancatatactctacnanatatacattatcttcntnccatctcacattnatctatntctcacnnnaatatnttncacctccactntctantctatttanctntcantncttctccctctcttntntcttanntccttnccatntctctcannctnctcntcatatgatcactntgnngttctatatcntatncanactcacatcgatttactnacnntananaccctantnctatatactatntaatnntcatcatatntccaatattcntaaaccnncaattactcccactantatnttntcctactttaanaatgactnggtaatcatnacttaatactnttttctcatnaccatnttaccnnntactntnactctctttatcatcatntncnttanatttcantcatacttngtaattntttntttcncantatatnaanttatcnaattttaccgtctacacatacntcattatcatctatctctcactatacttncntactnatntcttatctatcnatnctatatctntnnacatcnctncncnnatntcacctccnttccttcacnatanaacttntatcttacatctctatatatacncctactcatttatcaactctntcanaacannnntnntnntntantctannannccntatttnatacntanacatagactntcacnnaatntctcnttatcactntntatannatacacttnttctatacntacttnnttctncatatntatcnctanatnnttatccantanttnntntcnccnattnnaaananttacagcancnaaataaatntttattnntctaccttnttnatcttgtnccttccttnanaatttaattnnctnnctnctcttnaaactncacccntatcaccctntcnttcccatnntnnatcattacaatcattnnactaactanc

SEQ ID NO: 4399 - DNA, 741 bp, Homo sapiens
  misc_feature (1)...(741): n = A,T,C or G
gnttaatgcctttcnattgcttggctctcgatctttctgcaggatcccatcgattcggtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggntttctgtgtttggatgatgaagatttggacccttccattcataatccctttctaagtgaagggagaggctggcttggctgntccttgntattccgaaagccctggtttggggcccatgttcacactggctctcagtctagtcaggtgcaatgttcttgagaggtggggacctaattattaccagagtagcancaagagaggaaacgttgtgaattaagtattcaattnaaaaaggaacatgatttctacctgaaaaaangnanangnncctnncttgattancttcntaatccttnnnnatnnaancnntcctnaannantttaat

SEQ ID NO: 4400 - DNA, 768 bp, Homo sapiens
  misc_feature (1)...(768): n = A,T,C or G
tnnnttcngttnactcgtttganttcctatacaagctacttgttctttttgcaggatcccatcgattcgaattcggcacgaggcctgattgaggaagagaacatgctggcaccatctctgaagcagttttncctacgagtggagatttgccatcctacattccagtgagggttgctgaaaaaatcctatttgttggagaatctgccagatgtttgagaatcaaaatgtgaacctgactagaaaaggatccattttgaaaaaccaggaagacacttttgctgcagagctgcacccgtctcaaacagcagccactcttcaacttggtggactttgaacaggtggtgggatcgcattcgcagcactgtggctgagcatctctggaagttgatggtagaaagaatccgatttactgggtcagctgaagatcattaaagacttttaccttctgggacgtggagaactgttcaggccttcattgacacaactcacacatgttgaaaacaccacccactgcagtaactgagcatgatgtgaatgtggcctttcaacagtcagcacacaaggtattgctagatgatgacaaccttctcctctgttgcactttgacaatcgagtntcaccggaaanggagcacaaagatgctnctcangcaagaanaagggccttctcgggaaacttcttnccccgggaaagcccctgcantcttggctgggcagccctangtcttttcttacaaaagtacaagtgggccccccnccntttttanct

SEQ ID NO: 4401 - DNA, 463 bp, Homo sapiens
  misc_feature (1)...(463): n = A,T,C or G
tttcatnntttacaagctacttgtnccaagatcccatcgattcgaattcggcacgaggctagaagttcaacgggagacnnattatnnccatngnanacttncggaacctcgggttctgagtngtgctctcctcaactgcncgggtgagccttannccctggnttgtgcnanaannanacctnngtttantnngntncnccnnnnncntcttaaanncntannnnntnnagngctntaaancccangtgagctnatnaancaanaattggagcgnattgcatcccngactagngcggatgaactntntacagatgaccnatcatncttccttgagccaangngganaacnctgccgctatagaccntggcnatnactcnnnnttgacatnagannatnnnctaacnntncnaanattnctaggcnntccgnttctcangnnttatntttaacanctgnttcatg

SEQ ID NO: 4402 - DNA, 773 bp, Homo sapiens
  misc_feature (1)...(773): n = A,T,C or G
aaacatcttgaacccgtttgantncntatacaaactnctggatgnttgngcnggatcccatcganncnaatncggcncgagggcatagtcagaccntgtntnaaaaataatnatnatnannnaacccagtgtggggtnattcctttngattactattatnttgttctcagaacaattgatttnantttnatagactttctagcccttatataataatnctgagtnctcngccnncataanaaanctggaaaannnctgatcnagaaanaannggtactactntgangaatntttangactatnatactgagtncaatatgnaacacaattcngcgtnnctncctnngatganncntaaaatatttgaaaatttgattgnatnaaanagcatnttggataccnggaganactnatgntcnngacattangacatnctgtntgnnngangctcccgtcnnnaggaagccantnttccnnaanactaccttgntaatataaccgggancgggctttngnacctgccattntattgatnanattnaatgttnatatncnggaaaaaannggctcatgccgtgaaatgtggggtncatnacaagggaaaagttttctggnngcggatnacttctggnnanaactcangttctnncggactnggatntaatncnctccctttgctaggtttcctcccagganncngnttcnaaaggcgaatcaaatgccngccaacatttcaaattttnaagannggggnnccncnaaaaaaaaaaaat

SEQ ID NO: 4403 - DNA, 777 bp, Homo sapiens
  misc_feature (1)...(777): n = A,T,C or G
ttcnantcttttctaaatnncnggtcttgntctttctgcaggatcccatgcgattcgtgctattgtaataataacaataaagagaaattagaagtgggnntcagggtagaaaaaaatgcaaaggccttggtccctaggagaccaacactccagctgagctggccttagccccagccccttctaatttctctttattgntattattattattttctctgctattgtaatatttttttgttaattaaatgttttggtcaaaaaaaaaaaaaaaaaaaanaaaaaaaaaaaactcgagcctctanaactntagtgagtcgtattaccgtagatccagacatgataagatacattgatgagtttggacaaaccacaactagaatgcagtgaaaaaaatgctttatttgtgaaatttgngatgctattgctttatttgtaaccattataagctgcantaaacaagttaacancaacaattgcattcattttatgtttcaggttcagggggaggtgtgggaggttttttaattcccggcccgcggcgccaatgcattgggcccggncccaccttttgttccctttagtgaggggttaaattccccccttggcgtaatcatggtcattagctgttncctgngggaaattgnttttccngtnacaattccacacaacntaccaacccgggagcataaangtgttaaaaccctggggggcctaatgaagtggancttacttccnattaattnncgttgcgcctcctggcccnnttncnagtcggga

SEQ ID NO: 4404 - DNA, 863 bp, Homo sapiens
  misc_feature (1)...(863): n = A,T,C or G
ccnnactttncnattangtgnagccctcgcccanananattggcntgggctnaacgnanattatcttctnacnnatanntgtgtgcctattttttcataattcttnancnnangncttnttntaantgttccgctagnccanannntgcgctaacanatcagggcgccactgttgncggatnacnactgcnattngngcnctntnncattncnnaattgcgcntntnaaatcngatcggntcacatgaanatnanaacgtatatnatnnncnaacttgagatcttcnttcacgggnnctctnnnacngcttnatgactcntggtnacagcnccacggntcatcangcccccanngaaatgngactantcncntggancnnnntgnaacacctgnccttcacangtnactgatnaaggctnanctgntcangacanncnttaanccttncngcttcngtnctggaaccagaaggantnttnnnaaanggntcgatnacnccctantagtcttacctactgcanccatcactggaancatgctaatanggtcatgtggtcagtgtaancntnatcaatngaaacncccncnnannttnnccnntnanctcaacctaaatantcnnctttttaaataantncacnncaatggtnnaaactancctannaatnggcngttcccctngaatgcctccttctcnaagcntgcacacnttcntntngnancccnannntttaccctntcgnnatccncntgggcnttncctttattnatccacctatnggcttccccaaagaacntnctnngnnncaatcatccttgggannacttcctccnttnggnnaataacggcgcaaaanttnct

SEQ ID NO: 4405 - DNA, 424 bp, Homo sapiens
  misc_feature (1)...(424): n = A,T,C or G
ccntcgaattcnnncgaggagaaaagctntcangttanctgtttggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttattgatcatctgctttaggctgggctctatgttaggtgcctgtggattccattntagtacctgtgttctcatagaattgaatcctgntcccccatatgacttttgatgatattcacactgttaattccaataaagacagagtagacaaacagaaactg

SEQ ID NO: 4406 - DNA, 739 bp, Homo sapiens
  misc_feature (1)...(739): n = A,T,C or G
gnntcaatgctnttctctngttctttntgcaggatttcatnnnctcgnattcggcacgagagaaaaacaacagagagaaaaagaatcctgagaatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctggaaagaaatactgnctcatataataattagattggaatcattggtttaatctctgtctgggaaccaagattgaaagctgacttacttctctcttctgncttgtgaaccataccggagcctattatttttaaaatatgatcagacaagtaaggcttctcttacttttgctctgctctggatcaggaagancctcatggtgaagtctttgagantctcttattaatcatctttcttaaactgngtttttgagcctgacagtactgaaaangctggg

SEQ ID NO: 4407 - DNA, 784 bp, Homo sapiens
  misc_feature (1)...(784): n = A,T,C or G
cntcagcggccntgnatccaaagntgggggcgngcgnacganctgcgagcctgccttacgaggccgcaagccctttttgccaccctcggngncnggncgttccggccgttttggnggcatcanccgnccgncatggcagtgaacgnccngcaggcnccagccacngcctggggctanagattaaattgacnncccnagacccggcattatcaggagnngctanganncttnctgcatnctcggnaaactagcataagccaaagactcgccatgcagaantattagcanatagctgcgctcgataaaggaangaggagntaaanaatnaactagtgaaaacaagggagatggtggctttatcgtgggttagagctntnganctatgatgtcatcggctagatactatgtgaaatatcttactacnnttanncatgcnaatnagantgagnaagnctnngaccaagccccctttaatgagnncaagaaaaactcttggctggtagaggaaagnnaatcnagctanaactcggtgcacgaatatgngntcatatccaggcaaaccgggagnntgttgtaaacggtcaggaccaatggnaaccccttttnncctctgggggccttnngttggccaagggaacgcaattaaggaaccttaaatgcnnantagnnccnncaatttcccggnccatggaaannccaattgnccnggantgncccccttnngnccttgcctcnccccaaaagggggtttgnccaccaangtngnttggggaaaacaattccg

SEQ ID NO: 4408 - DNA, 1327 bp, Homo sapiens
  misc_feature (1)...(1327): n = A,T,C or G
gnnnngttnctnctcttnaaaccnttgctctngttctttttgcaggcatcccatcgattcgaattcggcacgaggggcnctgtctgcttgcngcntgnanacgatnngtttgatcntctntnaactannnacttncnnngttngncttattgcagttntcatcnaacgctaacantgtngtctctatnannatnttatgaagnacatatctacgcttnatgancantntntgtcanaannggncanancctatgtcgtgngcnttntttgncaattnnanaanangagctnanggatcnancgatgtgaaagnacagctntactctgaanacatgctcntcnnnntngnatgtccnnntacntancnaacgaaatattccnntaaagaccnganntnatatggacatacaagaanngtncttcaaaaaggtcctttantnnanagttnttncncnggtttgactaccttgtagntaatttactaggaattcttggtaatcgaaatccaacttnccgtcnnggaactcgttgngntcnantantnataaagtggnngngnngaaancctggnantaaangnnaaccctggncattggtnngacccattgngaattnacttttatcccaagttnggacccncttttacccccanttgccccnttgtgngcttttgcccccaaaaattcccccctntcccattaacncgttaanccaaatttttccgccggttaacaataaatttttttntanccctnaaataccnnggggtttccttaaaaancgtcnnatncctnaanttnccntttgaaatttccctttncncttctggggccnttantttgaaccccnanaanttnaacttggnccntccncgngtttaantcnaacannatttgcccttacntananaaaatctcctacctnttggtnncttcaanatttttgaacnttaatctnnattttanannnanttaaataaactgtaatcnttggaaanntactntgnnncccnaaattccnttatacacatnggtnttttnatgnnaccaaacttttgagnaaccgcatngtcttataacccncnaaatttcttccgtaccnccggggtntcttcaatctttacctcaaangnngaancgttttcctttgntttcttacnnatacggctncgtttctcntctatttttantccanctaatggtaattcacntttttccgganctcttctgacctatntnacntctcttcanatctccccctaaagtcctnaatctcnaacttccaattnttacccccantatcaatgttttccaatcccttnnttcnt

SEQ ID NO: 4409 - DNA, 1267 bp, Homo sapiens
  misc_feature (1)...(1267): n = A,T,C or G
ggcttctacnnnaanngntnggaaactcanncgctcganngcgcnngggangcnnctagatcacacggacngctaccancgagnagggntttnntnaccanaatcangacctaaatgcacggntntatgtaccctgnccaccatctngtgcctctttatcattngcctcttccntcctatntcccttgcgttaaggaanaaaaatggtgncacaatttgtcaaaagtnattttaanngnaaanccntnncatganagnaaccntgnanttcaanncgnctnnaannnnnctnctnnnccanngnggacntngnnnntcnnaaccctnactntnnntncnnganncncnnannnccnatatcntnncnngagttnaatnncannncancantttnnntannnnngaannangnnnaattgannncttgtnccgganntancntcangatcccannannantnccgancgnaanttctatnaantntncnancaccanatncngtcganacnncnncgtcnnncngcacnatncactgnnantnnancnnnagncnncactgnanntacngnanctacnagcgctgacnntncntntccnngcnngncnngtncngtanatcncncnatcatntnagatntcnnttnnatntacnnatntnnantntcganantgnntcagcgancntatatnngnganncnacctanagngcacannacanntcnanacganacactnctcncagnnatnttcngncgtnctctgntgagncnctacacnnngnncacnnctntancagagtaatcncacactgtaatcnntataccanaantctncgtacgcanancncncnnanagcatcncnntgctgacgtnnacncatntcnacatntcngcacgtncatntntcantancncnaatntcntatgnnctanngntcnatcntatatatnntnnttgatatgnntntncgntancanacacgnacngngnacanacancncactnnannnanganncacncancncntnangncannnttngnnnnctcgcnanancgtagnatacgntactcagngcntancacncganncgcgantatctcncaananactnnncgctnnnanntatcactntctcntacatcgantctcngcngatctacncgctcagtnncnnctgannnnatatnagnatcnctcncatngatnanantannaancactgnnncnncnaacgngtncgcntanaagtagancgnnctcg

SEQ ID NO: 4410 - DNA, 462 bp, Homo sapiens
  misc_feature (1)...(462): n = A,T,C or G
tgngactntttgaactcctgttctttttgcaggatcccatcgattcgatnatgnnncnanncactntganngtnnatttatnnntttctccnattccnnaactaatgggannccggtgctggtatnganncttggggaaaatacctggagataccagtgcagctattnaaagctgnagcaagggctgcaatcttgcggagattttaaagagaagtnttaaagtttctaatactgatgcctctttttggtaaatacaagttttatnaatcctgccctgggatcctgattccccattaatcaagatttgtcagacttcaccttctataattagaaaacacagttataagaacagtcaattttttaaattttccaaattaaaaaattgcaccatgattttgaacaagcacttccaattncattacccatcttgtatgccataggtgggagtataattgncacagc

SEQ ID NO: 4411 - DNA, 765 bp, Homo sapiens
  misc_feature (1)...(765): n = A,T,C or G
tnnnnttttnaannttttcctaatgctggtctcgttctttccgcaggatcccatcgattcgtttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggangctccttcatcgaatgctaaacctttgagtagaagtctncctggatcacataccaggtcagggaggatctgntcttcctctacgtttatcctggcatgtgctagggtaaacgaaggcntaataagccatggctgacctttggagcaccagtgccaggacttgtcttcatgtgt

SEQ ID NO: 4412 - DNA, 754 bp, Homo sapiens
  misc_feature (1)...(754): n = A,T,C or G
gnnttnanttnnnttccctttcaaatncttggctacttgttctttntgcagggatcccatcgattcgaattcggcacgagggaacctactagatggacaggctgaggtgtttggcagtgatgatgaccacattcagtntgtgcanaaaaagccaccacgtgagaatggccataagcagataagtagcagttcaactggatgtctctcttctncaaatgctacagtacaaagccctaagcatgagtggaaaatcgttgcttcanaaaagacttcnaataacacttacttgtgcctggctgtgctggatggnntattctgtgtcatttttcttcatggganaaacagcccananagctcaccaacangtnctncaaaactaagtaagagtttaagctttgagatgcaanatgatgagctnatcnaaangcccatgtctcctatgcagtacgcacgatctggtctgggaacagcananatgaatggcaaactcatagctgcangtggctataacagagaggaatgtcttcgaacagttgaatgctataattcacatacagatcactggtcctttcttgctcccatgagaacaccaagagcccgatttcaaatggctgtactcatgggccagcttttatgtggtacgtggatcaaatgggccactnaaattgacctgaagtggtggancagattaatgaattcaaaccatagnatgactgggttcctgtttcagaatttgagaactaacccgggtgtn

SEQ ID NO: 4413 - DNA, 1119 bp, Homo sapiens
  misc_feature (1)...(1119): n = A,T,C or G
ncncacnnnncantnntcnananccannnccaanncctcacncnnnnnannntctcnaaaccanccnnncgnctnncnatnacncaanggnaaggggcannnngattctagttttnntnnanttttttgaaaggccntttcnagagtcncttggcaagcngcttctaccagangaattcggcacgagaatnntccngtatntgnctcttcnaccctagaatnacttatanacgtataanntanncntcnaaatactnacaggtntnaaaataangntnatcaantactaatttaattctgtttcatcanaaagcacgaccatcgtggcatngaaacttgagttatagcctactatcangatcaatntaaaaaatatatatntagggctggntgcacgtggtgcacatctgtaancccaagtgctttgggaggctgaggngggtgaatcacctgaangtcacganttcaagaccaacctggtcaacatgacnataaccccatncctacaacaaaaatgtaacaaattagcnacgngttggnnacacacaccntatcactctacntncaatngggggcccgaatncngtngaanaatccgcctntgatctcttnagnaaacatncaaangcctgctncanaagctaatncatcattgcccnacctggaacttccaatccntnatngcnaancancaatctacncaccacntggtcccntaatatacggaacanactcacatcngactatctnaanantnccanagcnataanggnnacantnacnccancanntttncaancnntgccnaaananatacccnacaacaatntctagnacantatnnacnnncntttacncatncncncacatntnncccaaactcnantacacntccntcacactntcactcctctcctacntnnncnaaaaanactcntccgnaacccctccntnnantatacctcatntataccnnannaatctcctaacattttaccatntctcntnatncccnnnacacactttnnctnaacnncntctcnanataacgnaanntananctctcnangatntccaaaanactncacnaaattttgtcgcaaaaangtnntntnaccc

SEQ ID NO: 4414 - DNA, 788 bp, Homo sapiens
  misc_feature (1)...(788): n = A,T,C or G
gntttnnttcntttncttttcaaatccttggctactttnaattnctgcaggatcccatcgattcgnnttnggcncnangnggatntggcttntgnggaatnggatnnnnagctggtcgatgacggncancggatagananactgnagnanccntgctcnttgnagnncagtgctgtttangaanangatctcatngtntgnnttgannctctgnatgganccanggcgtntaccnaaantattntngacantgtgacacntcattattggaatngantatgannnanatgncatagcangaganataaaccagcnatattacaactatctcgcancgaccngatgctgngntctggaagacaatntggngagntttaggtntagcgccgtnnggntttcanctgntanangaacctgntgngaaanacattatcacnnctactcgntcctatngcaacaagaagnngctgactgtgntgctgctntgaactcctatgctgngctgctagtangatgagcangnaatangatnatcagctgannganngcnaagnctctgcttattgtntgngcaaatgctggttgtaagganntgaggttactttgcgctttgggnaagtncntactanattnnttnttgggacngcaangntttnnccgggtgancccaangngnaantggnaccttantnganccnatnaanggnntntcananggcatagtnnancctggannaaaggangttncnagnnntttanntncgggaaatnnnngacttactttttcg

SEQ ID NO: 4415 - DNA, 1411 bp, Homo sapiens
  misc_feature (1)...(1411): n = A,T,C or G
ttgtnnnnnnngttttttttggcggtaaaaaaaaanggntttttttttggggggaaaaaannggggccgtttggctnngtggaaaaaaccccccttttttggggggaaaccnnttttcggggngaaanngnncncngnngggnnngnngnnnnnnggggnnngngagggnnnnnnggnnnnnngnggnnnngngntnngnnnannggngggngggnngnanttttnttgnnaggnggaggganttnttnggnngttttttttgncgnncggggnnggntngggnagnggggggcgagggaggggngggnncgngggnggaganagnaaggnagggngnggangcgtggggtngnggganngggnnagannaggcgnnatnaggnggnggggnngggangngggggagngngggtagnagnggggngnggnnngngngngggagggnnngcgnangggacgncacagngggggtcaannggnganggganntgnggaatgcnggnngggcncgggggcngnnnggagnggggntgggacagggtgnnggangccannnaggggngggggnnngccgagngcattnggtagcangnnnggcnnttcggggggngccnnnnggtnantgacgcgngcggggggngnanatncanggggnnagngnggggaanggcnccncgngtntgggggggganccnntgagggggngnnaagnaggggggggaagncngccaanngngtgntncngggnnnnanggngannnngggggggganngngncgggnganggggggggaaccnngtnnnngagaagnccnntgnangntgggagggnncggnnncangggggnggncanggggngnnaanantgcnnnngggggngnggaggatggcnggggagcntgggganagatgggggannnnagagcgnngnagnngtgtgngggggnggngatnnagagngtnnnggggggnngggnggggnnganngagngangggggnnaaaagnnanagggctantgggggggggnngannggnaaagagggggggggggggggngananngnngcgagngngnnggnaaanggggngnaaggggngntgnnngggggganaggggggntntnngngnngtancntngggaannnggggggggagngngcagaagnncngggggggnngtgnaaaangaaantgngggggggnannnacaggggggnannaggnangggggcnccganagctanggaggggnnnnnnnggnggtgngggggnganngggagaanaggggggggggtngngnaaggggggggnnaanagggggggannaaaaagagtnngggggggnagaanngnnaggggganggggngaggnggggatggggggggggnncacncannaccgcgn

SEQ ID NO: 4416 - DNA, 768 bp, Homo sapiens
  misc_feature (1)...(768): n = A,T,C or G
gncttttacnaatgcttggctacttgttctntttgcaggatcccatcgattcgnattccgnacanngggcatacttgntgccttccangngnactntcaccaangtntctggcgtacancgtnnagancngcntgaccgcacnccatcgtnangngcagnngtgccttgctnctgngaanggggccaagtncggtntgtcatgcctntgatnccacnactgnnggaagctgatgcangcngatnacttnangtcatganttcnanaccagactngccaacatggtgaaaccntatntttactatanacaagagtagatcganngtgggngnngcacacttgtaatcnnagntactcnagatgctgntgcnnaatanttgnttnnactctggagatngangtngnantganccaaaatcgcnccnctgngctccaacctgngngacanagtaagaccctgtctcataacaaacaaaatacaactcnagcctntanaactatagggaagtcnggattacntnnatccngncatgatanggatacatcgattgantttgnacanncnacaacttggattgcaggtgaaaaaaatgcttntattttgtgaaanattncagtgctattgcttttatnttgtaaccnattataagcttgcaaattaatcatgtttaancaacaacnngnttgcattcatnttatgtttcaagtttnaaggnggaacggtntnggnaaggttttttaantatggcggtccggcgnggtccaannn

SEQ ID NO: 4417 - DNA, 782 bp, Homo sapiens
  misc_feature (1)...(782): n = A,T,C or G
tcnnnctttctaaatgccttnggnnntccctttctaatngcttggctacttgttctttttgcaggatcccatcgattcgaattcggcacgagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttcctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgaaccgaagagttttgggaacgcagtccggcagaaaaaaccggaaccggcgggaacatggtgtctatgcctcgtccaaagaagaaaaggattggaanaaggagaaatcgcgggatccnagaactatgacccgcaagaagggacnaganattaaccgggattagaaagtaggcacancnt

SEQ ID NO: 4418 - DNA, 747 bp, Homo sapiens
  misc_feature (1)...(747): n = A,T,C or G
ggngnttttatcagctcttgttcttttgcaggatccctcgattcgaattcggcacgaggtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatnacagtgaacacactggggagacctgctttttttggaaaactcaaangtgctacttcctgattcaaagaaatattctcatgttggtcattctagtttatattttcatttaaaatcct

SEQ ID NO: 4419 - DNA, 748 bp, Homo sapiens
  misc_feature (1)...(748): n = A,T,C or G
gnttnnttcntttcctttcaatncttggctcttgntctttctgcaggatcccatcgattcgaattcggcacgagcagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaaggacaggatctaactaacaatgtgaggctgtgtcttcacaccaattcaacagagtatcttgtaaatgttgagaggagangtactttangtcatggggtgtctttcaataaagtgctttagaaaacaggtgacaactgattgggccttgaagtatgaatggatttagccaggcaattaaataggaaagcagatactcaagacagattaaaacagctttgagagaagtgaaatgagcaagtgtaaagacaattgatactgnncatggattttagaaagtgtgaagtggagtgattgtgatgaaancttggaaagattgccttgggccaaggctgttgaaagctttggttttgcttanattaagtcaaatgccgtann

SEQ ID NO: 4420 - DNA, 748 bp, Homo sapiens; identical to SEQ ID NO: 4419
  misc_feature (1)...(748): n = A,T,C or G

SEQ ID NO: 4421 - DNA, 1407 bp, Homo sapiens
  misc_feature (1)...(1407): n = A,T,C or G
ggnttattcnttcctncnaatncttggcacttttattctgcggatccctcgattcgaattcggcacgagggctanctggcctcgtngnactattgtatgtttgnngncctgngnncttaacacttttnngcagttgtgcttnanctaatgggctaattgntttnaanntngnngntntcnanttaacnttttctttaaatttnaaanngntnaataaatttctntnaatcnacccttannngtatatnaannncatanaannnnannnactttnanncntatttttnaaannnngacacctnnngatcaatntgntnaanntttnnatncctanctcnnnnagnnttttnnnaanccttcncctgganttnttgntcaanacngaattttcnttatctcnnntgcnnttttgngccancacnnttcntcancacctattgtgncctnngcgnannatnntttacncntgcggttgntatnnacancntnctcttgcatngcgtcattaacctntagtgtatccacanaganatattttttagaggcgtatntntnatcatagngannatactntcancnnaattagtgctttnaatattttatnctactaantgatntcttgnnagngtntcatatnngatcctaatattgttntntattttttgtaaccctattgtgcanttcncntataatatnnggganaatttgtgcnncntttatnttctctatattanacatnnatattgggggnannnttacnactcnnttatatnnagaaganctntactccntatgtnnnanataananactnntatacnctatattngnaannagncacnnnttggganngcttttanattactncatacatacatgnatgtntataannanngcttncnatatgngcacnaaaatactctatatgtnnttgcnttacnaacancactattnttatcntacnttattatnntnnntnancaacccnactcntnntatancgnctctctntntnctgtctcnntatnntntcgcnntctcnttnactntggngnntacntattattagagangngnngatttatntctcntctgcgctaatggantnacaagtncntnntatannatanattngtncnctnncantcaatnnttatnnctntacatgnattagcatnatntnccnnnttattgtttaantnacacccntcaagatnntctactatgagantacacancttctcanananntatgnctcaatgtanatcntcctcactcgngnttttctgtccacatnttntcanaacttctancntntactaatatnntctaaantnccncgtnnatnctctncangnngnctgcncntcctttngnnntnncatatgnggtancatttcntcncnct

SEQ ID NO: 4422 - DNA, 1407 bp, Homo sapiens; identical to SEQ ID NO: 4421
  misc_feature (1)...(1407): n = A,T,C or G

SEQ ID NO: 4423 - DNA, 804 bp, Homo sapiens
  misc_feature (1)...(804): n = A,T,C or G
ggttanttcntttcctttcaatccttggctacttgttctttctgcaggatcccatcgattcgaattcnnnncgnggaggcctncgcggcatctggnnncnttgnnatctgnttngcngntngagcgatnntcggctgttgtggacacgcntttnangcttctgttgtgcatntannttgattcacatngncttacacantgcctggangctgtctnntaggctaatgcnacttncacattgggagatacacctgctgatagtggnnnatngacncnctganttaangtgntggannngatnngtnntttnanngnntggnnnaaactnntcntattcncntgatgnnactttggatcncactnctgaggganatcngtnatggagcnanctngggcnggngnaccnncttntttttagaanatgaaatcatacatctgngngnntcagtgntnnnctggatatcngcntctgnnttantnacttccacccanagcatnatangacctcngacttanccngngtcnnagccttctganatnnggnctggaagnctgntnggctnccttannnnnccctnttgagnatnatgatnnaacncggctttgggnggttcccactgatntgacactgnctangcaagatncccaangatggcgantcntcttgcaatttgggaaggaantccnttttntncngcttgntagnatngccttnnnnataaccttgctttgaanttntttaaccccnntaatccagnttngannttgctttaggtaaaanccaattgcantcgnnananancg

SEQ ID NO: 4424 - DNA, 749 bp, Homo sapiens
  misc_feature (1)...(749): n = A,T,C or G
gnttnncncctttcaattncttggctactngtctttttgcaggatcccatcgattcgaattcggcacgaggaggatctgccttctgaggaagtggatcacgagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatancaggagttattaaccagccatattacaactatgaggcaggaccagatgctgtgttggggaggacaatctggggagttttaggtttaggcgcctttgggtttcagctgaaagaagtccctgntgggaaacacattatcacaactactcgatcccatagcaacaagttggttactgactgtgttgctgctatgaaccccgatgctgtgctgcnagtaggaagagcaangaaataagantattcagctgattgaagcaaagcctcttgcttatgtatttgcaagtcctggttgtaagaaagtggggataccttgtgcttcagaaattattttaacatgctgntgggaggcnanntttaacccgatatcccattggggaatgttctttcaantcccanaaggttgtnaagcatatgaacttttctnngagtcctggcccactgtggaattatgactactatgcanc

SEQ ID NO: 4425 - DNA, 727 bp, Homo sapiens
  misc_feature (1)...(727): n = A,T,C or G
tcnaatncttggctcttgntctttntgcaggatccctcgattcgaattcggcacgagntngagctggacactnagncacagtttagagtnttgatatatnactngaaaacagtancattnccnaanaccnatnaccccnaccctgtccnaangaatgatngntatgnatgtgaagttnatnttntgactcngatnatnacnttccacttnggatgcacaaccatgctgncctgtacagaagtcacangtnttgtgagaatttntaaactgatgatgtgnattnncatggnaacatgagtctacattttaccttcnatagtagcnatgaatcacaatnacntctttgtttataggttggtggaaaantaattgctgttntgccattgcttttaatggctgccacaactactttngcacnancctaatatttattaanactttnctttctnganacacaattnctgaaanngggattnatgtgctgagnctctaaggaccctgatantncntngtatnnntngttgaatgttgnanaatatttcatnactactcaantgatggtnctatgatctgggaggaagcctncttnagcatnttanccanattgnccagggtttcnagganaagtctaaagcctgtnangataccnatgggaccccaccgnggtgnaanggcttnntgtcttncggggactttgagcttaattttcccangnaaaaaanggctt

SEQ ID NO: 4426 - DNA, 753 bp, Homo sapiens
  misc_feature (1)...(753): n = A,T,C or G
cctttcttgaaaccnttggcnacttnctctttntgcaggatcccatcgattcgaattcggcacgaggaggatctgccttcngaggaagtggattnagagctgattgaanacannnantgggaagaaatactgnagcnaccatgcncatcncantncantgctnttaaagaagaagatctcgnggtctggnttgatcctttggatggaaccanggantataccgatggtctncttgacaatgtaacaggtcttattggaattgcttatgaaggaaaagccatagcaggagttattaaccagccatatnacaactatnaggcaggaccanatgctgnnttggngaggacaanctggggagttttaggtttangngcctntgggttncatctgaaagaagnccctgctgggaaacncnttatcacaactactcnattccatagnaacaagacggttactgactgngttgctgctatgaacccngatgctgtgctgcnagtatgaggacagganattngattattcagcttattnanggcaannactctgnttatgnatttgcnagnnctggttgtnagaattgngatacttgagctccagaagncatttacatgctgtnggaggcangttaaccgaatccatnggnatgttcttcagtccaccaangatgttaaccatntgaactctggatgagtactgccacnctgaggattatgactactntgcaagcccannacatgngngagccccctnctt

SEQ ID NO: 4427 - DNA, 863 bp, Homo sapiens
  misc_feature (1)...(863): n = A,T,C or G
tttgnaaanccctttctgttgttcaccggaaacncttgggaaattcccatagctncangcannnantgcgatggcgtgcgcctgtagtcccaggtactccggaggctgtggcagattttnggcttattgaacacaggcagnttgtggccattcagcaaggagcataatgcccctgtnggtggtgatagtgaataagcactcagtgcagncaataagnatataattngagttaatgcatgncnaatgattccngtcccttgttgaatgtggatttntntatctcantnccaatacatttnctacaaagccaagtgccattccctggaattggccnatagcaatcnggaatgtnnaccatnggattcactcactggcagntcaagtctgtgaacaccatgaaggttaatcaacatgagggtttaaagccaactttataggcttgctatatnnnccttcctggtcagcaatanagcccattcncnggagcttccngnggggatgactcgtcccagngaatcttcctattaagnnaaccnannggnttaactgnagaaaaggcttnccgtnatctntaagatccttttggaaaccacntttantctaccctggcctncaagntccaatttgganagacccgnccatnnancctttggangaaatncccaatnccaggaaacccaatggccaaaacccctnttnnaaggnnncttnaacaagcccagggaaaaccnaattncccnaaanattggggccnntnnnngggggggggnaaaaaggctnnaaactntcccnaacttaaaacaaangnccccttgggnttntcaaaaaaanggggcntttnggaanggaaaangganccccna

SEQ ID NO: 4428 - DNA, 471 bp, Homo sapiens
  misc_feature (1)...(471): n = A,T,C or G
nntttactncctttnccccctctntttgcaggatcccatcgattcgaattcggcacgaggcagaacngatccagacanaaantgtntgcattttaccttntttcccncnccaattcttcttngtaganganagtancgtcagatgnctcttgncgancctnnnctcngttgnacatngcctatnctcctttnagatntanatgganatttgcttatgacttgtgttgnataacgaggtanaaanattgctgtcttctctgacatncctcctcaaaganatcattaatgtatgatatctaataaaccanctantgcatgtaacagtgatcagcaaattaatanatnanacctctattcatgcttaaattatcaaagntagtatttnaatganatgtgctattttcattaaaatntntggcaccatcgagnatganacttaccaattgcancnnaggnantgagccctnacnc

SEQ ID NO: 4429 - DNA, 976 bp, Homo sapiens
  misc_feature (1)...(976): n = A,T,C or G
nggggtataaannnnnttttnngaatacagctacttgttctttttgcaggatcccatcgattcgcannngngcncgnnatntgntngncnatngaactgncnnngcacatcaatattngtgggnttncncnatctntcatnnantgtgnaanacagatctgacttggttatgttngagtgaccctgancaatgnnngnagacggntaggggtacacggagcacacattcgtcacaaattctatnggtgcatnttttgcaagggncgtttccagggtgcttattancganngcaaagggtacttggcaattgcaagattttncaatgagccccaagnaattcntngancgaattgcattggcaccccaaggtttnaggaaaagatnggnaaanccanttaccttcnaatttccaaccttgnnattttgaccttggantggttttaannaanaccccagggtagttacccaacntnngggcgantttncnaaagtnccccnatcccttaattccaccaannaanggntttaaaanaatggcctaatttcgggcgagttattcgaagaataatcgcttantngtggtncaaaacttacattactcaatggaaacattcacccaattttngaaagggaatctttaattcggcctggcattaaatccggagntgtcatgggctttcngaattcaaatgaaannggttatatttctggggngcaagatcananttgacganacccaatggaangatctactgataggcangttaccatcactggaatctgntgccagcatttagcctggctcaatatctaatcaaatgtcaaggcttttnccttgggaaaacgggttggcattgggggagcaactnggaacaatgcagattcaatccattaatcccttttctggtgttcaacaaccaacccattgaatccatctggggtaagttttcttgaaacaagtcancngaanttccn

SEQ ID NO: 4430 - DNA, 765 bp, Homo sapiens
  misc_feature (1)...(765): n = A,T,C or G
tnnnnctttnctaattgncccctnattngcnggttccaatnnncanngaacgatcccatngattcgaattcggcacgaggtttttttttttttttttttcagttccagttccactttctttttatttaaataaccgaagcaacagccgtggcacagcagagggaagctgggttggggcgtgtganangtggcagcagtntggcctgatggggggactangtcacagtgaactccccacacgcctntcaggttcagcagtcatggccataggattgggagcactacggaggagccatcagttagtgatgtctctccaagtcccanagaccttagggacgggagctaagtcagctccctcaagtagcagggccagggcatcccagtcaggggtcacggggcccggaaggcattttcagcagccccagcggctgcattggcagctgcggttcgcaccncanggttggagaagacaccancagcaaattcttgctgggccttctnaaagctggcacctgtgcggcggtataaggagtggatcccgtttcagcatgacaattcctagcacagcaatgccantgaagagcagggcgaccagcacatgagcaccgatactgcttgtgttgcccttcggcaccaccanagcagaatatccaccctgaatnccaacctgggatncaatggcctgaggacaangacacattctggacgaagaaatganaanaaaacnagaaatttgatgaactgtactncggaaagcctttacat

SEQ ID NO: 4431 - DNA, 739 bp, Homo sapiens
  misc_feature (1)...(739): n = A,T,C or G
gcttcaatnctttctaatncttggctaccggntttctgcaggatccctcgattcgaattcggcacgagagaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaaagaaaagctgttcaagttataaaatatataatctggaaagaaatactgtctcatataataattagattgtaatcattgntttaatctctgtctgggaaccaagattgaaagctgacttacttctctcttctgtcttgtgaaccatacggagcctattattttaaaatatgatcagaccagtaaggcttctcttactttgctctggctctggatcaggaagagctcatgtgaaagtctttgagaatctcttatttatcatctttctaaaactgngtttttgagcctggacagtnctgaaaa

SEQ ID NO: 4432 - DNA, 1006 bp, Homo sapiens
  misc_feature (1)...(1006): n = A,T,C or G
tatctttnctaaaangnccgtaantgcntggttttaattnccttggaangctnacntgcgttncgnattgggagncaggcctcatcaggaccctgntgactcgnggcgcgggagctggnagccaggctctncgngcctttctctggcttccttggntngcctgntgggggaagggnaggaggagattaaggaaangnaagatgttccacnntagantgatgaggtctaccggtncaagaccatcncttaanacgagnatcccnancctntgcctnnncgaaatgtnanctcctnncactnggcnccnagttatnagcccctcngaannntgtnacagccggacgtcttantncnttctgctcaangatgctcnaacncanncttnnattnggttgncngannntgcgggatnncngcncnnatatcnnncattgnntncncttaantggttcttntgnccccctttnaatcccttccantttgaantccttntgtggnttanaacgnnttnnngaattaatanccnncntataccattanantattggtacacnccttgnnttaccaaanttncaactgggacttttggtnatattaaaaggntatntntttatnatncnctccctattggggcncnaattcgtatttanagccttaaaactcnctcttctattntatanaccnctnccnntattntantctncccaaantttatataacgncnaancctatcatntatttctngcgcatttccnngattttnnataancatntntcatngggttataaancctnngntnaantgtnnntntctntncnannnttnttntnntaattttcaantgtacccnatnatnnnnncnaanaaccttntgttnacccngtttcnanancnntttttgnntcccatttanctcannnggncttcnnttaancanncctggggnntaatntnngggannnnctatttntntgatntttaaatagtatantngnataacaannt

SEQ ID NO: 4433 - DNA, 474 bp, Homo sapiens
  misc_feature (1)...(474): n = A,T,C or G
nanccttacaagctacttgttctttgtgcaggatcccatcgattcgaattcggcacgaggaaangncnagcantgangaatgtntttggtntttggagccacattanatcngnaanctctatgactatatccantgtncnctcccancagcanatngangncatgcatgcctcttttcntaactananananaacnntgggctcnngannctgngttacatcccannngctttnatattgcctcatggattcattggaaatacacgtgnatacacaaantcccanatnngtcttgcattntattttngangcnngcttctncaatanncanntntctntnntnaaagattatttgangnaacctaaggtccgtgagtctgtnctntaacttattgatgacnnataagnncagcattttcnntcncactgtcntnannnacctgntggnatcagcntcantgtctnggtngnacg

SEQ ID NO: 4434 - DNA, 764 bp, Homo sapiens
  misc_feature (1)...(764): n = A,T,C or G
tnnnnttttgaaantttttgaaatcnctggnttctaatnttnggcacgatcccatcgattcggggatgggcctatgattgttcatgatgagcatggaggagtgtcggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttggttttagtgtcaaatttttagctgnatttgtagcaattatcaggtttgctagaaatataacttttaatcagt

SEQ ID NO: 4435 - DNA, 747 bp, Homo sapiens
  misc_feature (1)...(747): n = A,T,C or G
gnttcaanncntttccaaatncttggctctngntctttttgcaggatcccatcgattcgctcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacnggtaaaaagagaaccttagatnataattctgggagttcttcactttcagtctcttcagcagagacatggnttcattcactggtctctggttggtttctttaatcacccccaaaggtcgcgataatanttatttgcccc

SEQ ID NO: 4436 - DNA, 747 bp, Homo sapiens; identical to SEQ ID NO: 4435
  misc_feature (1)...(747): n = A,T,C or G

SEQ ID NO: 4437 - DNA, 741 bp, Homo sapiens; identical to SEQ ID NO: 4399
  misc_feature (1)...(741): n = A,T,C or G

SEQ ID NO: 4438 - DNA, 804 bp, Homo sapiens; identical to SEQ ID NO: 4423
  misc_feature (1)...(804): n = A,T,C or G

SEQ ID NO: 4439 - DNA, 785 bp, Homo sapiens
  misc_feature (1)...(785): n = A,T,C or G
gnnnnnnnttcccctttctaatcncttgganntcgctctntntgnangatcccatngattcgaattcggcacgagagaaacacaggtgtcgtgaaaactacccctaaaagccaanatgggaaaggaaaagactcatatcaacattgtcgtcattggacacgtanattcnggcaagtccaccactactggccatctgatctataaatnnggtggnntcgacaaaagaaccattgaaaaatttganaaggaggctgctgagatgggaaagggctccttcaagtntgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgncctgattgttgctgctggtgtnggtgaatttgaagctggtatctncaagaatgggcanacccnaaagcatgcncttntggcntacacactgggtgtgaaacaactaattgtcggngttaacaaaatggattcacttgaccaccctanaggccngaagagatattgangaaattgttaaaggaagtcagcacttncattaagaaaattggcctacaaatccnnganacaataancatttgtgccaatttnngggttgggaatgggtgaccaacattgcttggagcccaagtgnttaacaatgccttnggttnaaagggantggaaaagttacc

SEQ ID NO: 4440 - DNA, 789 bp, Homo sapiens
  misc_feature (1)...(789): n = A,T,C or G
ngatatcggtcgctgaggggccaagtgggaggcctngnnaggtgtggaggtggattccgctccgggcaccgatctcgccaagatcctnagtgacatgcgaanccaatatgaggncatggccgagcagaaccggaaggatgctgaagcctggttcaccagccggactgaagaattgaaccgggaggtcgctggccacacggagcagctncagatgagcangtccgaggttactgacctgcggngcacccttcagggtcttgagattgagctgcantcacagctgagcatgaaagctnccttggaagacacactggcagaaacggaggcgcgctttggagccnagctggcgcatattcaggcgctgatcagcggtatttgaagcccaacttgggcgatgtgcgaagctganagtgaacgggcagaatcaggagtaccagcggctcatggacatcaagtcgcggctggagcangagantgccacctacccgcagcctgcttagggacagggaagatcactacacaatttgtctgctcaaggtctctgaggcagcagctctggggcttttgttgtccttggaggtgttttctggtagagggatgggaaggaanggacccttaccccgggtttttcttgactgcaataaaattattgggcaaggaaaaaaaaaaaaaaaactccagccttanaactatanngngtcggnttcttaaatccagacatganaanananattnttngtttggacaaacccaacttnaatgcnatggaaaaaatnnttttttttnnaa

SEQ ID NO: 4441 - DNA, 1450 bp, Homo sapiens
  misc_feature (1)...(1450): n = A,T,C or G
ggnnnnncncnnttttnccncnccccccctacattcgaaaaaaacccccccnttttgggcccaaaaaaaanccccccccccnttttgcnaaaaaaccccccttttggcnaaaaaaacccccttttggggaaaaaaaancnttnccncnancnnccanacngnnnnnncancccgannaannaggnnncannannnannnnnnnngannannnnnccncnnattattttnnnnnnnncnnannngnnnnanannnncnannaaannannnannnncnnttnannnnnanncannnncnnagnagngnnnnnncannanaannnnngnnnnnnanaancaacnanaannngngnggnnannnannnannnngngnggcacnnnnanacnaacanacnnnannnananannaanacannnanacngnccnnannannanannngananannaanaccaannnnnnnancnnaanncannannnncnngaggnccccccncncaccanancagaaagaagacanganannnnanccagaangancncanannacaaanacaacnanacnaanaacaaanaanacaacanaannaanggcnnaaannnnncaaacanaaannngcnanacnaggacganngcgacaaacnacnccnagacatanacaacanacaanacanacnaacanaananncnaacannaaacagaacaagacncagncagacngnancannncncganacncnaacaacaancngccaannncanaancaaananacncacanaacananacnanagnnnaaaaangaagcaaanacganacnnanannngaagnanncacncacanncnanagcaccgacanagnganangacanganagannnaanccaacaanngaacaaagacncggnagnacaccnnacnnaagaaagcaacnaanancnccacnaacancngnacacacacacannngnganaaacanaccgnnaacaanacangncaaacgnanacnaagcacannncnnacaagcgacnngngaaagacaacgacacancagannacgacgaanngancaangnanagacgaaacacgnaccnnggaaanncaaagnaacangcacncacacnngacnacaaacanannncgacganacgnaaagaacgngnacncgnanannggnacacaaacnaancacaacgaacgacanagacgcanccacgcncacanngcccnangananncgagcacncagncgacgncgnanancacgccacacancnaacantaaannnggannnagacancnggnggagantcgacanngngacacagaacacanacnncannancaccnnncganacaacaacnagcgnacacnacgaacacanacancacaccaacacgnacaacangnacaacnnagaccnacnacccncgaccccaacn

SEQ ID NO: 4442 - DNA, 1450 bp, Homo sapiens; identical to SEQ ID NO: 4441
  misc_feature (1)...(1450): n = A,T,C or G

SEQ ID NO: 4443 - DNA, 775 bp, Homo sapiens
  misc_feature (1)...(775): n = A,T,C or G
ccttggnnagnngcccccttnaaancctttgaaaacccttggcaaangccctnncngnnngatcccatcgattcgaattcggacgaggagaggatcacttgagcttaggagttcaaatccagcctgagccaacataacaagactttgtctctaaacaaaacagttattgtttaaagaatctgaaatcttcatctttaattcaggtagcaccgactcgagcccaagtttgtttgatatccagttccaagtctggagagaggcatctntatcttattaaagtatcgagagacaaaatatcagacagcaatgaccaagagtcagcaaattgtgatgcaaaagggctatcaaagggaggctttttacagagaactaaggaagagaaggaggttgttaaagagacttgagatcagaaaaagatcaagaacaacttgaatctcaaagtatgaatttgaagtattttgctgagcaaacatttgaatgcctgtatgtaccgtaatcctctatcactggggtccccaaccccggtaccagcccgtggcctgctagggactgggcccgcacagcaggaggtgagcagngggtgggcaagccgaccattcccacctgagcttncccctcctgtcagatcagcancagcgttagattctcataggagtgcaaccctattgtaaactgccatgcnagggatctaggttgcacgctccttatgaggaattgaatgccctgatgaacttgncactgncttccatcacccccagaangganctggctaacc

SEQ ID NO: 4444 - DNA, 799 bp, Homo sapiens
  misc_feature (1)...(799): n = A,T,C or G
ntcnannngngtccttggcccttgctntttntgcaggatcccatcgattcgccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgaaccccggagaggacccacgcgtgacccgggccaaagtacttcatttcgagaatgaagtttcttganggatcaagcacttgccagtnggaaaatngggccgtnacttactggttaccccttcattttnaacctncgcttgtngggaacaacttggggaaacaattccgnccgtngtggtttcaaaacggaactgggcccnnggacaattnantttaagcgggcaatggccacccttttgggtcaangtnccnaagcctggttttt

SEQ ID NO: 4445 - DNA, 890 bp, Homo sapiens
  misc_feature (1)...(890): n = A,T,C or G
gaaaggggagngnannttttnaanggcgttctaatgntggagcacgannctanaaagcgggttnggcacgaggctgnanctgcccgtgggcaccacgggnacactgtcttccgggacctgngggcccagannggctgggtgacgggncttcctaacagagtacgcggggccccttttcatntacctgctcttctacttccgagtgcccttcatctatggccacaaatatgactctacngtccagtcggcatacagtggtgcacctcgcctgcatctgtcactcattccactacatnaagcacccggaatanagcccgctgccccagtcggaaaaaaanaaaatnaanannatancctnnatgnataancaaaacttgngcctnttaaancttagtgagtcngaattacntnaaatccagaccatgatngagatcccattgatgaagttnggnacaagcccncancttagaaatgcnanggaaaaaaaaattgctttaattntgttgaaaatnngcngaatgcncatnngcctttantntgntnacgcnattattnaagcctgngtanttaacccaangtatatccacccaacaaaatggcatancaattntatanggtnnnanngctntcagngngcgnnaggttgctntganagnggntnttcnnaattncctncggganctgagngagccccaaatagcntttgggggtcccnggntcacctcanacnttncgggatatannccntacgnaannannggggtctaaanttgggcnccaccttgngngcgnnnaaantctnnnngggntcnaataanncttnnttnntcntnnngngttnaanaatntgnanatatacncncgtatacatanacanntctcnctgnccg

SEQ ID NO: 4446 - DNA, 740 bp, Homo sapiens
  misc_feature (1)...(740): n = A,T,C or G
nnnntgnnnnnnnntttnnnnngngcnttttatagncngctcttgttctttttgcaggatcccatcgattcgcagcaggnttgccnngtggctgntatggcatctatannantttcagggttnccntaaccnngggncccntgcnntgantgacngtgggnatcntgtngtggtaangancncaggacncnttgnatntnntggaaacaaatggnaacananngtatcctctnnggatactggctncccanntggnttaacacaggtancagctgctcannttnacctgagggatccagaggcnnttgtcaaactagctattcatggcatgctgccaanaaaccttcacagaggaccaatgatggaaaggntgcatctttttccagatnctntattccagaanatntnctnangaatntncnagangagcttnctcaancncgaaaantacctaaacgtntanatgagtnacacacgaagaaatggacgccttcccaagattgtggactccacctgacnattatcggctatangagagtaanacttgnacanaataacagtgaagtgattgaaactttcttctgangagtttctctacctacaggatggagttaaacactgntacagntcacacctgttttatgtgcngaatcactgtggggaaaggtactgacgtgtannncttcaatagganattggattgaaatntcactttattgaaccatttttatgtnatctga

SEQ ID NO: 4447 - DNA, 1221 bp, Homo sapiens
  misc_feature (1)...(1221): n = A,T,C or G
anggccanngnnttttttcccaaaaagnggccccnnctttttccnaaaaaccccctttttgccaaaaaanncgccttttggggccaaaananntgccccgcnngnncnnnggttttggnncncnnaaaannnnnnnccccncnnannnnncncnnnnncnncnnnnnnnnnnnnnnnnnncannanncnnnnnnnnnnnnngnnnnnnanacnnnnnnnctttttnnnncnnnnangnnngnggggnnnaannnnnnnnncgnngnngcannnnnnnngnggggnanannncaanngannggnccnccnnnagacaacnnnnncnnnanannananacnaannncncnnnnnnnanaangnnncncnnnnannannncnannnncngnncccccccncgcnccngncnnngnggcgcaanacntnanccnnnnggnannnantncgagantgncnnaatnanngccncacannaagnccanaaccacaatncnnnanaactnctnnnatnngaanacanccagancccaaanaccnngnnaacacnnaannanaacccanctnnaagnnacgccagnngnanncaccaanacncncaannnccagnnnnaccnaacaccacgcnanncctnaanacanacnananncaaancnatngncncacgagtgngtaacnncnnaaccnacnaacacncagncgnncanacncncnannnncatnaccnacacnncnncgnaaanacngacnaacaaatcnaanaagcncnnnnantnnancaagnanatncnancnnnacgacntananantanccacnnnanacacacacncgacgagncaacaacnaccatnncnngcacgnaccnncngtctnnncacaanacactanncanccacccgnaaagaagaaactanccaaanntnnacgancnacctctnnaagnnccgcnagannacnanncacgncccaantnacaccnnacnnccnnacacncnaacgtnccannacataacnngaaccanaccacngcangaannnnacannncaagnnannacancanancnnggaacnnnagcgncgancanccnacgncgcaanncgacanaagntanagaagaacnacnaaacnnannncaaannnaannaaacctacccaganngtnnacacnacacantncnncnnacgagccgcatnnnncnananacgacggacancaaccc

SEQ ID NO: 4448 - DNA, 910 bp, Homo sapiens
  misc_feature (1)...(910): n = A,T,C or G
gnnntttcaaatagctaggctactngttctttttgcaggcatcccatcgattcgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaatatacagaccatcatttagcaatactaatacatgattttccttggggatggcaggtttgagaatcctttagcaacaggacatactttccctaaattancnngggaattatttttttacccggggttaaaagcttttcaggntnccaaancttaaaggtgggggttgtcttaaccaacctaaaaaaacttnttcaccttaaaattcttcaaaaggaagaaaaagttnctttggccaaaaattttggtaaaaagtttccaccaaangggtggcaaaaaccattttttcccctttccttttaanggccnttttnaatccttaaagggaaaaggggccttntttgaaaaaacttgggggcccccaatctgggtanttaccaagggccttccaaaaattttacccgttttttttnaaaangggaaaggaaaatcttnttgnccaacctttnaagggcntttatttggccaggggaaaaatacccttcnattttngggnantggttaaaaaaanttttatttgg

SEQ ID NO: 4449 - DNA, 783 bp, Homo sapiens
  misc_feature (1)...(783): n = A,T,C or G
gnntttnnannnccngntttctaatnctnttcnaatnctttgnnancgttctntatgcangacccatcgattcgggaatctcctagaaaagttgtgattttcgagccatatccttctgtggtagatcctaatgatcctcanatgttggccttcaaccccaggaaaaagaactatgatcgagtaatgaaagcactggatagcataacttctatcagcnaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggtactcagggatgaacaagaaacagaaggtgtcagccaaggacgagccagcttcaagcagtaaaagcagcaaatacatcacagtcacnggaaaaaaggacagcaatcccaattcctgccaaagccgtaacttaaaatgcatagnccttatgtgaaagggatcaccttcatctggacctgcacaaacatggc

SEQ ID NO: 4450 - DNA, 746 bp, Homo sapiens
  misc_feature (1)...(746): n = A,T,C or G
gntnngnnnccnttntnagggggtntaatgcngctctgttcttttgcaggatccctcgattcgaattcggcacgaggaatacctcaaacgtctaccattacngtggggtagantttagcccacntntgcctttncancntangggttnttcntaagaagaantactttgattctgaacttgagcttatgacatacattaatgaaaactgggatagattgcaccctggagagctggcngacacaccaaaatctgaaagatatgagcatgttctggaggcattaaatgattacaagaccatgtttatgtctgggaaagaaatacaagaanaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaaagcaatggcatataaaaaaaaggaaagaaaaaatctgtaggtcgtccacctggcccatatacaagaaaaatgattcaaaaaactgctgagccacttttggataaaggaatcaatttcagagaatcctacttttggatttaccttggnctatagggagaactgagggaactgccattcatccagtacctcagatgtgggattttacnggtgcttncagtgcaaaaagaaactaccttcgctagcattttcnggccattatgattattn

SEQ ID NO: 4451 - DNA, 769 bp, Homo sapiens
  misc_feature (1)...(769): n = A,T,C or G
gaccnatcggttngngagacngcctnccnntcnnncngcntctgnnggntgntnttttgacacggtctcnngtgaaagtacncacncactcacacgnnaatgggcattgcaccccactcctgctcaaagngctgnacgcngtcatgngtagaattnctgtacgcctgnnctctgncccntanngcngantgggccacnnntntntatgancgcgacaccaangtgagtctgacctttctgacttgannnacaangtttgngggggctgncattcgtgntttnngngcncttnnaancatnataggagancntnatnnncgactgggaacnnnctnnacacatnctatctgngaantcatggggatcatnggaggaaacccttgtgctcgaaaataacgtgngtcaaacatgcactcatgngnccnggcnnaccacncntngnctgtttcctacctaaggtataccatggnatgnacacttacngtaattntgcaaagtnggcaaanatnttctcanancggagcctaacngnctaaatnaaaggtntttcatnnccagggncttgttaatatnggcnaaatntggcnaacaagnggttgactcactttaaaaggtgnaataagattttccncatttnttnaaaaggaacctggnngaaaaagntaagggccaaancctttaagncnctttncnggnaanggtttggccaaatccggggttggngggnnccaanaatgnttttcaggaggatngggnaaactttttttct

SEQ ID NO: 4452 - DNA, 1366 bp, Homo sapiens
  misc_feature (1)...(1366): n = A,T,C or G
ananaanannannnnnnnaaggnnaananannnnnannnnnaanangnaaanananannntnnanaannnaagnngnttcnanncttttcaaagcttggaaaacgcanncaannnnngggaaagcaagaaagaacagctaaagnnngncncagaganagcttttangangtntangaagaaggaatannngnggncaatannnnannnncngaaantatcatganacncaaatgangganaaggcagcacaagctgngcaaacagctatngngacgggggggccgggagagnctaaangncananatncaatatataaggactgcatgcnaagggatacnaaacaagnanactnntctaggaagaaataantnttgacntancnnacnttcataacgaatagcaccgtacatcgagncaaccaactaanaggnctaaggaaatggcaaannacnttaatnnntgagcnaaggaagggngtatngnccnananngaaatgcntcntaaccaanttttaatngtaacggnatnangatnaanncntnancccacgcaactcaaaaanattacattanntaaaaaaganctatancaaaactagtnttcaaaatngnacgagnaaatgggnaanantttntnnccgggaaaattggnagagatccanaaacactggntnagggnaatanatgnccgcccnaaaaaaccntnaccataggnatnggctancatagangagatatancnatnaggggatcaanancntaggnattngaaaantaancgagttaaaacancnagatnnggnantacgaganatagcttggacgngtatcaaatcggaccctnggatgggcntanggaaaaanaaaaaggntngagngaanttcctcanaggaanngtganagagcnaaanaanatnaagggccttggngaaaanggaaaaacagatagngtcatncnatatatncnnatgananantggggnaatntaatctacnntanatnngggggaaaaaaatcnnncatgacnnnaaaangagntaatgnnannatgagagattaaacnnataaaacnagagaantttgngnaaanctgngagataaaaaataaataaattctntntggaacatntanaccntctatnnaaaaaaaagaggggaaaccatctngattatgcacananaaatntnacntngnggaaataaatngggnacaataacatatatgnggatgtacantnntggncngaaaaactatacaacntgagannnnacnangatataaagcnnnaggnagtntatangggcatcatcaangggaagntataaagcaactgnannctcatatanaaaactgnncnncaa

SEQ ID NO: 4453 - DNA, 852 bp, Homo sapiens
  misc_feature (1)...(852): n = A,T,C or G
tgatcctcaggcnnctgggatgacacgtnaancatagaagctggaggaggnggnccngcgcttgntcataatttaaaaaaattaaaanaacgcaacagccgcttttcttaatccatatcccttttaanacacagaggcnggtaatnagtgnaatagaagaatgntnttgtntcttcctacggtgacngttnttattncacnggnttctttagcaggactgttctactcaacctctgtggaanaaaactntccncagggctgnctaacacanncagcctttgcttttacancctgctcttgcctattaccataccactgtatgtnttcttccacctntggacnnggatgggtattaaactcttnaggcatnantgatgcaactanagtcaatatgctgtntntattaatgagagctcttgggcatccatntcntgaaagctcaantggatngaattnagntngcggganagaggctttnctttgctcatatnacgctnatggactggggnaggctnaaattgcaaatgctgcttttaattgcnctcttggatcnacccatgaaaaattggaaggctcttgacnaataactggtggngtcanaaananaacatttttgacncnggtcatgntntggagaatgaacatccctaaatcnaccatgtggaagaccnatttcataaatncattcntntaanaaaaaattggnaaatctttnttttgctttggtnggaacaactttnaangggcttttgngcaaagtcaccatggttaangggatggacttgnaattaaattncccnaaggaattnaanggttggggaaataatncccctnttaaagggaaaaaaaang

SEQ ID NO: 4454 - DNA, 799 bp, Homo sapiens
  misc_feature (1)...(799): n = A,T,C or G
tggttttnnnngngggggggttttctaattgcagtcaanntngntgtcctanncccgntnccncnggncgcccnaacttggaggtggcccgcttccagaccatggaggagaagaaagcattcattnntaccactgaagaaagaccgaattgcaaaggaagaaggagcttaatgccaggaacagattttgcagttggtggggtctcaataaaagtttgtttcagtggaaaataacttttattgagacaaaaaaaaaaaaaaaaaactcgagcctctagaactatagtgagtcgtattacgtagatccagacatgataagatacattgatgagtttggacaaacnacanctngaatgcagngaaaaaaatgctttatnngtgaaatttgtgatgctattgctttattngtaaccattataagctgnaatanacaagttancancaacaatngcattnattttatgtttcaggttcanggggaggtgtgggaggtttttttaattcncggccgcggtgccaattgcattgggcccggtccccacnttttgnncccctttagtganggtcaattncgcgcttggccttatcntgggtcatagctgtttcctgtgtnanatnnaatgncnttncacttttcnnacaattnaagtngcnnnagaaatccancactgncaanttgggggcanncacngcttgntaaatnnggtatttttcnaggagcttttaantanntnggntcaanggnacaagcnannttagctccatnggcttngacctccnttannaaccaaaatgnttnn

SEQ ID NO: 4455 - DNA, 793 bp, Homo sapiens
  misc_feature (1)...(793): n = A,T,C or G
gnannngccncgnttttgattccccttnttcaaatcctttgnnaatcgccctcnctgttttgatcccatccgattcgaattcggcacgagatggcagttgcttttgaagtatatgatgnnttcctccactacaaaaaggggatctaccaccacactggtctaagagaccctttcaacccctttgagctgactaatcatgctgttctgcttgtgggctatcngcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaaagtaatagagtnttgcttaatcattnggaattcaaacatgctatattttttttaaaaatcaatgtgaaaacatagacttatttttaaattgntaccaattacaataaaaataatgggcaattaatttttnaaaactttttaaaatagnatgctcatatttttaaaaataaaanttttnc

SEQ ID NO: 4456 - DNA, 1095 bp, Homo sapiens
  misc_feature (1)...(1095): n = A,T,C or G
cgnnnattttnccgcccctcctgggaaaatcnccttgncnngtgaaaaaacncntgggtgaaaaaccccttttggcaaattttcgttgnaaaaannntncccccgannnngnnnttnnnnnnnnnnnnnnnnnnnnnnnnnnnnnnnnnnnnnnnnttttttttcnnnccccnttttttttttcngnnnnnnnnnnnttnnnnnnnnnnnnnngnggggnnnnnnnnnnnnngggggggnannnnnnnntnngnnngnnnnnnnnnnnnnnnnnnnnanncnnnnnnnnnnnnnnnnnnnnnnnnnannnnnnannnnnnnnnnnnnnannnnnaannnnnnnnnnnannnnnnnnannnnnannnnnggggggcggggngnncgnnnnacgacngnanannagnnacnacngaananannagnannannnnnnnanaaaannnnnanagnnaanacgnagnaanaanaagnnnnaanaangannacgnnnnacanannncnnanaaannnacaaacnanacaanatanananncncnagannaananacncnagaanaaaannaagaannnaagcnngnnncgnaananccctaacncananngaaagnacngananannnccgagannaanagnnaagaaagnaacanagnngnnagangagaaagacnannagaacnanaangananangcannnngcncncnctnanaaanananannatanangatnnaancgnnganagnaannacnagnncgacgcgnnngananngaacgganntcgnnnangggnnnaancacnncncnaacaagnanangcgagagtcaananncanannnanancngaanannannnagnngnaananananacanacnanaanangnnnanagacagangcangannnngcgcnannagnagnagagnnnatnangnntananaagncananacgacannanaacgtnacgccgnncnananangagannnnganaanacgngagagagnagaanagnacanagananagcnacgnnngacagcanaaacganncnanaagcggnaaatanngangcnagnngnnngacagcc

SEQ ID NO: 4457 - DNA, 744 bp, Homo sapiens
  misc_feature (1)...(744): n = A,T,C or G
tttnttccttcctctaatccttttancgcctttctgcaggatcccatcgattcgaattcggcacgaggggtcctccaagagtttggggcgcggacnnnagtaccttgcgtgcagttatgtcggcgtntgtagtgtntgtcatttcgcggttcttacaacagtacttgagctccactccgcagcgtctgaagttgctggacgcgtacctgctgtatatactgctgaccggggcgctgcagcacggttactgtctcctcgtggggaccttccccttcaactnttttctctngggcttnatctcttgtgtggntgagtttnatcctagcggtttgcctgataatacngatcaacccacngaacaaagcngatttccaaggcntctgcccagagcnagcctttgntgannttctctttgccagcaccatcctgcaccttgttgtnatnancntaggtgnctgaatcattctcanttncntaattgangagtanganactaaaagaatgttgactctttgaatctgctggataagagactngagatggcagcttattggacacatggattttcttcngatntgcacttactgctagctntgctanctatgcaggagaaaagcccatagttactgcgtgtnacaacaactntctaacnaacattcattaatccannnganncctttcaangaatggtaancctatgccnttcaanatactgaacttnntgccacttntggcaaaaaaaat

SEQ ID NO: 4458 - DNA, 809 bp, Homo sapiens
  misc_feature (1)...(809): n = A,T,C or G
tatcacatatacacatatgtgtcccatatacacatatacacatatgtgtacccatatacacatatacacatatgtgtacccatatacacatatacacatatgtgtacccatatacacatatacacatgtgtacccatatacacatatacacatgtgtacccatatacacatatacacatgtgtacccatatacacatatacacatgtgtacccatatacacatatacgcatatgtgtacccatatacgcatatgtgtacccatatacgcatatgtgtacccatatacgcatatgtgtacccatatacgcatatgtgtacccatatacacatatacgcatatgtgtacccatatacacatatacgcatatgtgtacccatatacatatatatacctgtgtcctatatatacacacacacacatatatatatctatatacctacatatatatacacacatatatatatacctggatcattttttaaaatgctcaacagtacacacatgtaacagcatttcagtcaatggntggactgcatatttgatggtggcccataatattataacggacagaaaaattncaatcacctagtgaagcatagcacaatgcattaattactcttggggttggggggcatggctggtgtaaacaaacctaccatgctgncagtnccataaacatatagcatatatagggtatatattatacttnaataataactatggtgntggggtaagnatttaatgnatttaccatggntttaaaganaactcctcctacttttttccaaaagtactntaaaacanncn

SEQ ID NO: 4459 - DNA, 840 bp, Homo sapiens
  misc_feature (1)...(840): n = A,T,C or G
agggccagtttgatcattccaaagatggttggttaggccccggccctatgccagctgtcacaaagcggcaaatggacactcaagaaccaagatgatatcaacctccatcaagacagctcggaaaagtaaaagggcatcagggctgaggataaatgattatgataaccagtgtgatgttgtttatatcagtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggatagtatttcataaaaaaagaaaggcaaaaataattttcaaaaatgattcaagaaatgctgtcaaagatagcaaaagaacagagtcctcagagaacagtgcccaggacaggataagcactcaataacatataacactgggtaatgcttgttgagtgctggctggttgttgagtgctanctattggtggagtgcttgttgttgagtgctaactgcttantgctanctggtgnttgagtgcttggttggttgaagtgcctnncttgtttggttgagtgcttgttggttgaaatgcctacctggttggttganntgattgttggttgantngctaaccnnttgtttnatgcntnctngttgttgaatngctttgtngttnaaagctaacntgtttnttgnatgctttgtcctggcctggggcccttntttttacccctttgatgtnccatttnttccatttaactttccccaattnccctntttgggnnc

SEQ ID NO: 4460 - DNA, 980 bp, Homo sapiens
  misc_feature (1)...(980): n = A,T,C or G
ttcctaatnctnggctctcgttctttttgcaggatccctcgattcgaattcggcacgaggaagccnaattgaattgtgggaacaggaacattcaaaggcatttatggtgaatgggcagaaattcatggagtatgtggcagaacaatgggagatgcatcgattggagaaagagagagccaagcaggaaagacaactgaagaacagccaggctggtcttgaattcctgacctcaggtgatccacctgcttcggccttccaaagtgctangattacaggtgtgagccaccacgcctggctaattttgnatttttagtntaaatgggggttnttncaaagcttggnctttgaanttncccaancttcanggnggaatncccnccncccttttgggcttcccccnaaatggcttgnggantttccannggccntttaagcccaaccnttngcccccnggncctggaatngnttttttttgaaatggaattttttntaaaaaaatgggggtttttncnaggccatttttaaaaaaacccntttanaacttggatttttttaaaattattattttaaaatttcctttttttaaaaacctccaaattnttaaatgggttaaaatattttaccttggtnanccacctttaacttaagcctttttcntggaaanggtttgggtccntttggagaatnaagaatttggaaaaaatggaccaggtttngtttggatttttcttgaagggtaaattttacccccaaaatttaaaattattatggtattgtggtaccntttgaaaaaaaaaacatnttntannncttntntnctctaanncctncttntnntataaaaaaacctncnnngggcccttttaaaaaccttttttgnggggnggtccctttttttaccngntanaatnncccnaaccttngatttanggnnannccttttgnttgaaatttttgnncaaaaccccccaatcttttgn

SEQ ID NO: 4461 - DNA, 761 bp, Homo sapiens
  misc_feature (1)...(761): n = A,T,C or G
tgggnnnnnnnagngtnggcttttcttattntggctgtaaccgntngnagcncgcacncaaannggctgggncgaattcggcacgagggttggaacagcagcactatacatgaaatataaaccaaanacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatctttatgatgctgagccatgttctgcactggtgctaatgtctaatataattntatatttacacacataccgtgctacccagagattaatttantccatangaaccattgacccattgttcattgac

SEQ ID NO: 4462 - DNA, 753 bp, Homo sapiens
  misc_feature (1)...(753): n = A,T,C or G
gnnnnnnnnnnagngtttgaantcctccttngaaatcctttggcnactcgctctttntgcaggatcccatcgattcgaattcggcacgaggggcaatgcagttataatactgtgttaatttcagacatcttctggtcctccgagccttgtatttacatactagctgaaactgcaagtggaaatgaatggagctgatgatatttgccttatcctaatttttctgtgaggaggagaaaaacacttgtgcttcaaataagcagatgtgaaaacacttctcactaatcaaaatgtttaccactaggttatgagagtctgcctctcataggcagtgaatctgatatgtatacttagtaatataagtctatttagtttgacaaaaccttagagcagaatttttgcagcttagttcaggatgatcactagcaatgccaaacttcattttttattgaacttggatccaagaaggcctgctgtgtctatttcagtatagactctcataccaatatatttatgctccaagtcactacacccagaagtgatgcagtgggggaaatgcaaagacaacatcactgtaagattcacagaatggatcttttgtaaaatattttatattgacttaaggaaaacctttcattgggaattaattaaattaagtctctaatatcctggaagacagtaaaaantnaagcnggtgntctcaantttgaacccggcnattngnaatttcattataggaatttctgaaaataatcc

SEQ ID NO: 4463 - DNA, 913 bp, Homo sapiens
  misc_feature (1)...(913): n = A,T,C or G
gcgtcccntttcaacnttgctaatcgctggctatcgttctttctgcaggacccatcgattcgaattcggcacgaggccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgnataacaaggancatgttattgatgccctgnnncagggccnanaccnagtttnctggccttnntancntanngatnttngaganaagtntcattttaactttnctntgnctatatnncaanggttttanntttngtngantgaaaaagcgggcttcatcccaagatggnctgtggnggtcanagttncattcccnagtngtnnncccttntgganaanttggctggccccttgcactcattgacggccttcncaattggtgctnnanccccctttttaatttctttaatcnaatnnactttattacctttncctggctctaancttaatnntctcatctncatctntaatntctnacactaccnannttttnntcantattcccntcnaacctnatcaaactttttncg

SEQ ID NO: 4464 - DNA, 1274 bp, Homo sapiens
  misc_feature (1)...(1274): n = A,T,C or G
tttttngggggggttttttnnnnnnnnnnngggggnnttnnnggggggcngntttttnccttaaaanagnngactggnnnngctgaaaaactcgggccttgggggannnngnccccccncgaaaaacancagggaaaaaaanggggggggctgggggggggggnnnnnannnnnnnnnnnnnnnnnnnnnnnnnnnnnnnnnggnnnnnnnnggnnnggnnnannggnnnnnnnnnnnnnnnnnnnnnnnnnnnnnnnggnnnnnnnnnnnnnnnnnnnnnnnnnnangnggnnnnnnngnnnnnngnnnnnnnnnnnnngnnnnnnnngnnnnnnnnnnnnnnnnnnancnnnnnnnnngnngnnnnnnnnnnnnnnnnnnnnnnnnnnnnngnnnnnnnnnnannnnncnnnnnnnnnnnnnnnnnnncanaagggnnnnnanncnnnnnnnngnnnnnnnnnnngncnnnnnnannnngnnnnnannnnnggnaagaangnnncnnacgagnnnnnngannnacgannnnngnnaancnnnnncnagngccgnatnagancacgaatnggngagaggancngannangnnggnnnnnggnnaangnnncgnnaangaannggnaccagnnnggannncnnnannggangncnnnagnnnnngnngggnnncnnnaacncnnggggnnnannanngnanannnggnnctnngggnnnnnnnnnnannnnnnnnnaannnnnnnnnnnnnnnnnnnnnncnnnggnnnngggnnanannnnnnnnnnnnnnnnnnnannnnnnnnannnnnnannanngnncannnnnngnnnnnncnnnnnnnnnnaggnnnnnnnnnnannnnnannngnnnnnnnannnnnnnnnnnnannnggnngnnananannnnnnnnnnnnnnnnnnnanangggggnnnnnnnnnnnnnnnnnnnnnnnnnnnnnnnannnnnnncnncnnnngnnnnnnnannnnnnnnntncnnnnnanccnnnngnnngnnacaannncnnctngnnggnctnngnangnnncncaanannnntnnngnnnnnnnnntngnngncaaanangggnanannnantnnnnnatgggngggggacnnaantnnccnccctnattcaannantggnggaaaaaactggnggnnnaanantnaaaccccagannggcnnaaantcattccttaccaaaagggttangacctggnaancctngtgggcnanaaaggtnctnaaacattcntttnanc

SEQ ID NO: 4465 - DNA, 1039 bp, Homo sapiens
  misc_feature (1)...(1039): n = A,T,C or G
atggnnnnnnnnnnnnttttttttggaaaaaaannnccccccctttttttncctnaaaaaattgggccnttttggggcaaaaantttnggccctncttcntnctttggnntnttgnnnatncccccnattcgggnattttnccggaaaatttccggggccnaccggnagggggnattaggccctttnananagncccaaanggtntnttacccaaagggntataatttttaaagnnatgggggnaccagggtgtntngccccaatttaggaaagggaaattttntctnaaatnaagttgggggtntanntggccangtggttacctnggggcattnggnaaatatnttcttgggaacttgaggtntaaactggaangggagnagccctnaaacctatagtaacttcanntccccacaagtatactagaattngtgcatcctcgatttatattgcaagngtntcaaangtgtcactgnnacacaaatagaaacactgccaacttggtgtaacttaagctnncatttaactaaaacattnttttcttgcaaaacttatttattcatgatcaattttntggttatntattatactttgattcctaaattagtncatccttgaatctatgaaactggtgcagtcattatgcccnnaaatnntctnaaaatatattaatgggtcaccttnctgntcaaaggggtggtgcaanggncttgcagcattnttacatnttgtgctttgntangaaaatgtaaactctnaggctccacaanttnactttgctgcattttttaacaaanaatccccaangggatatgtaatgctcataanaaatttgggacanctgggttcnantggaaaaangggntctnaagggnatggcataaacttggtggtnccggtnanggntttnaaggccttttccaactttanannnntttctgattttggaantnttccantnggntntaanaacctnnnttatatatcnaanattaggggcctttnaaaaaaanncttatttnngctagnaaaccntnc

SEQ ID NO: 4466 - DNA, 931 bp, Homo sapiens
  misc_feature (1)...(931): n = A,T,C or G
ggaagcgggggggtacgttttncaaaaggnntttcaatngcnggtgaacgcccctaaanannnanccatcganacnaattcggcacnaagggcttccgnntaaaccantcangggtatnccnatgnntaagncatcctnggncngnntataacnggncccattcanctgtnanatanancttcnananttntcnacannggnnnanattttnnntctgcaatnnnanagnnaaccttnttnnnncnnnntaangaggcagnnagctacctttgaangaactacttgnnaacntnntnttgnaattcaangnnaanccntcttnttntcnanntnnttantgttgcnnnnnnctcaantcgtatnnncatgngggctcccatcacntnnttacttataantantngnttanaaannntngncctantatagggnnatncntnttnnnnannnnnntccntncaaatcccaatctngnaangaattnnccntttctgnaatncaattattnaangannaatngntnnnctantncattnannnnctantantttcncnncnnnncnttgnaattcncnttatacccantaaatngctactnttaatnaggattnanagtacccannttgcntttnttncacaantntaancnntgcattatntaaaatcannnaagncganaaattntnntcnaaccccnngcnncaaantaccnatttctaatanngacntannngnnnnnannnccctaanannatatacnanatntnttnccnnacantccnagagtagaantccccttnntcacacnnntctctantacncntnaattttcnntacanatataaantantttntctnattaangnnnnntnnaaanttctancnaanntanattancnancctctnanataatcntttttnnngnatnc

SEQ ID NO: 4467 - DNA, 804 bp, Homo sapiens
  misc_feature (1)...(804): n = A,T,C or G
cnaatncttggctactcgctctnttgcaggatccnttttgacgcntttgnacgnccgtatncttcaaccaatgtctagtgcacntatcctntntaacncanaattctcaaacccagntttacaacattgggtaggatnctataaagngctaatcntattctggatnatgacgaattttgcatgctaantctttgnancnngtcncccccgaagntgcnttacatgtacagattcgtgtaaccacgtgtaaccacataaaactnatgaacacaaagtccctcatgctaccttctatgcttacactcnanccaaacctaacnctgccaaccnctnntctccnatcaggatcattncntcanntcatgaatnnganagaantnaaattgtnnttgcacatggtatntataaattttatatngataagccatntgaatgcttatngatagagagtctgtgagctcntggcatttctggcactnagcanattacncctaaggnttatatgagtagannaanagntgtattancatnannttntaccaccatgnatcngacccgatgaaannnggtnatatntgagagtngtgtacaggatttnatgtgnaaattcgnatnnattcancgatgaganatattgcactgttntcccnggtcntaacngccctggnatnaaanatgccttgggaaaaatgttatcaaannaacntnnancagcccnangggnaaaaaccnnangaanttcagaggcntcntngnaccaantntggaggnnnaaaanaccngggncncctgganantaattcc

SEQ ID NO: 4468 - DNA, 1116 bp, Homo sapiens
  misc_feature (1)...(1116): n = A,T,C or G
tantacntanctnanccntntggcntnagtccgtccnctatcgcntgtngcttaaattactgncgcgttaaacgtcggactggaaacctgcgtaccaactaatcgcctnnagcaaaatccccttttggcagctggcggtaaaancaaaaaggcccgaaccgatcggcctttccaaacagttggcgcaaccctgaatgggcgnaatnggaaccccccctggtaagcnggcgccaattaaaccccggccggggtggtgggtgggttaaccccgccaaccggtggaanccggtttacaacnttgggccaagcggcccccttaaaccggcccccggctttccctttttcggcntttttcnttttcccccttttcccntttttctttcggccccaaccggttttcggcccccggggcntttttttcccccccgggtccnaaaggcccttcnttnaaaaaattccggggggggggccctttcccccnttttttaaagggggggtttncccccgaaatttttnaaaattgggcctttttttnaaccggggggnaanccccttttggnaaanccccccccaaaaaaaaaaaaaactttttgggaaatttaaagggggggtnggaaatngggggttttccaaacgggttnaaantngggggggnccccaatttcgggcccccccttggnaataaagnaaaccgggggtttttttttttcggnccccccntttttgggaaccggttttnggggaaggttccccaaccgggttttccttttttaaaaataaaggngggggaacttccttttgggtttncccnaaaaacctnggggaaaacnaaaacaaccttttaaaaacccccttaattntttcnggggncctnaatttncnttttttgggaattttnaatnaaangggggaatttttttggccccgaanttttccgggncccttaattnggggnttaaaaaaaaaaatggaaagcctggaanttttnaaaccaaaaaaaaatttttaaaccgccgnaaantttttnaaccnaaaaaatanttttaaacggcctttnaacnaaaattttncccttggaagggccnggggggnaaaaaaaaaatttttttttttttt

SEQ ID NO: 4469 - DNA, 766 bp, Homo sapiens
  misc_feature (1)...(766): n = A,T,C or G
aatncnagctctcgntctttttgcggatcccatcgattcgctagttcgagttttttttttttttttttttcatgaaaatatagtcatcaaatttattttcattgggatgccattttttgaagaattcctaagactaatgtttcttgacatgcaagagttagcattaatagcttacgttactataaatactgctgcttggaagcagtacaactgttttagagttttaagactacagactttcattactcaaatcttattcagtaaatgtaaaaatcagaaggttctgaacagctggttaggaaggtagccaagatgcaggaaagatgtctgcgcctccttttcaagggcagccaactnttgaacagtaggtgcccaaaatatccacatggcctttatagctttcaccaccagcagcccttttntgaccgtaggtaactttcccatcaaattcatccactggtacctttatatccggntnaacctgagaaatggtncagttcaggngttcttctatctcagatagtaactgcatctcgttgtaccatatggtcaagcctcatcttccttgagtcttggggtataacacccttttccacggntgctacatacatggnaccnaaccataaggaacaccgnggatatcaattcctntagcagntcatctgngcaaatcaagaatctttacatctccttcttaaancttttccaagtttgcctttctctcatgggccattggaaatttctcaaaataatgaccaggttttct

SEQ ID NO: 4470 - DNA, 926 bp, Homo sapiens
  misc_feature (1)...(926): n = A,T,C or G
annnnnnnnnannnnnngnnggngnnnnnannnnnnnnngaannannnnnnnnnnnnannannnangggggnnnaacnnnnnnnannnnnnnnnagnttgaattcctaaagccaaaccncnnntttggcaggaagcanncagnccngggntccgcaacgcnggnaagnggacagnnnggaaaanaaatntttngcagacaaggatgtcaagggnggnggcgggngnataacacncggcaagtgggacagcnttgaacaanaacnagnagncgncnggaacngcctaaccggagccnanngctcgaanaaggaaataaggaagccacanggnangcagacctcactganacatgaacccagcgcanaggtggcggancngcncnaaangacnagagaggcanagngaaaaaanncatnaatgccngncnngagaatgaanaacagcgctacaacaggcatgnggatatgggaaacaacnantggggacnaganacnnagggaangnacgggannaaaaaaggggggganttnaanncnccganggagggngcgagnacncantggaaagaaagggaagacantncacggaaancnganctgacaaangatgaatangnggccacagggaggaagggaactggcctgagagggaanaaancggnacnnaangaanggaacccagggccaagggcaccaanaagaaaaaanccccngaaaaaaaganggggnantatgngcctggggggggnaaaagcccaccaanttaaaggcanaaaaggggggggnaaaaacnctggnntnncaancaanaagggggggcccncccgggggggggnncccncgaaaanaaaaacngggggggggnttnangngggnggganncncacccnncccnngaaaaaggggggcaaaaaaaaaaccccccn

SEQ ID NO: 4471 - DNA, 924 bp, Homo sapiens
  misc_feature (1)...(924): n = A,T,C or G
acaccttgggtgcnngcaccgcatnanaacccantcccaccacannncangagcnngtngnncnctnttggaggnggcnnagngatgncccgaatccgtgggctactagggagccctcacttgggctacngggtggaggcccatgatattgnggcctcaaagatgttatgattcacctccatcaanncccngaantgaataattcttcctatcanttaatnanggtgattacccagnagaatgccattncggtntgcnttggtatttnacaaaaagaanctgggggaaccacttgggtgtgacattttatgggttnaaaataatgatctggnaaattgccccggatccnccatgggggaatgatagatcgacaaggtctacttcatggtgggagatatgattaaangaagncnatggccattgnggttnggaaataatccanangganttncanccaattactgnaaaaaaanttnnttggaagnggncacccctaaaaatctntcccagttnttagagnatacccnttacttccttaaanaagggatttgttgaaanngncanttttncaaatntaatnccaaacanaggncnacccttaatnaccntngccaaagnagcnngttttgnngatttttcccaaaagggagnaanattcctttccngnntttggcgaaactgtagnanaattcccnnntttgnggtgggcggnnnttagcccnnttctaaaaaaanggangngaacccccttgtgntttcntattccagagcccgctnntcctcngtaaanaananaaataaangnccanttnttttatnnanagaaattgggncccaatcttanggacnctttttgtgggaancttatnattcccnnacatacacaaaaaaaacancctcnccgncccctttnnnaactttncg

SEQ ID NO: 4472 - DNA, 902 bp, Homo sapiens
  misc_feature (1)...(902): n = A,T,C or G
ttcagaagaacgcacagatgaaatgacacataaagaaacaaatgagcangaagaaagattgctcgcccagcttcttcactaaatcatcccgcagcagcagggactcggtctagcaaggccatcttgttgccggacctttctgaaccaaacaatgagcctttattttctccagcgtcagaagttccaaggaaagcaaaagcttaaaaaatagaggttcctgcncagctgaaagaattagtttcggatttatcttctcagtttgtcatctcacctcctgctttaaggagcagacaaaaaaacacatncaataagaacaagcttgaagatgaactgaaagatgatgcacaatcagtagaaactctgggaaagccaaaagcgaaacgaatcaggacgtcaaaaacaaaacaagcaagcnaaaacacagaaaaagaaagtgcttggtcacctnctcccatagaaattcggctgatttcccccttggctagcccagcttgacggagtcaaagagcaaacccagaaaaactacngaagtgacagggaacaggtctttggganggaccagaaagaaactgtntttcttttnccaaagcanaattttacgccaanaaaaaatgcttgttantttttttggggaagatttttaatgtacccccttntttggtaaaggtcantcaaaaaataggtggnggggattanttnaaaataatnttaanttttgggnaagnaaaaaataanttttntttttnaaanttntttggttaaaaatttttttntggttaaaacaagaaaggggcttttcaanttaaggttaaaggtnaaccttcccntnttgggnggnggaattgggtttcaaattcccncgggccaaaannnttccctantttttaatattttaaanactt

SEQ ID NO: 4473 - DNA, 816 bp, Homo sapiens
  misc_feature (1)...(816): n = A,T,C or G
gnnnnntttcnaatncctttcctaatacnagctctcgttctttttgcaggatcccatcgattcgaattcggcacgaggacttctgaagaacatgaagcaagcagaagggtgaaagcggagctgctggttcagatggatggtgttggaggtacttctgaaaatgatgacccttccaaaatgggtatggttctggcagctctaattttccctgggatatagatgaggctttaagacgacgccttgagaaacgaatctatattcctttgccgtcagcaaaaggcagggaggagctattaccaataagtctacgtgagttggaattggctgatgatgttgaccttgcaagtttntcagaaaacatggaagggtattcaaggnccggcatttccaacgtgtgcagggatgccttccttgatggcaatganaaagcncnttgaangttttgactnccaggaaatccnaaatcttttcnaagaagaaatgcncatgcctacaactatggaggatttcnagatggctttnaaaaagggttctaagtcagtgtctgcttgcagacatttgaaaagatnccagaaatggatatttgagtttggatcatgctaaattctccatgtnaactgtgagaaatgtgcccttaagtggtttgaatattaaatgcccgtaattcattggactggagtgcttatatttttttttaactttcattaatggtaagaattttttttaaaaaaaancccttatgaattcttgnaataaaaggccaatattttttnaagcctggaaaaaaaaaaagccctnttagaaactntttgtgga

SEQ ID NO: 4474 - DNA, 878 bp, Homo sapiens
  misc_feature (1)...(878): n = A,T,C or G
ttcctaatncttggttctcgnatctctgcaggatcccttcgattcgaattcggcacgaggggggaaaatgacagaggaaaaagagaaantggancaganaaaaatagtggaagaaatnatagctaaaaaattcagaattcagtgacangtagaaatttacagatatcngatcatatgctcaagaaacaccaatgngaataaatatttannantcccacgctggttcttgcaaactttttgaaaaccaannttgaanagcaaatnttgnaagcacatgataaaagccatnccnnnaatnatccagttaattggcttgacttcttactggaaaccctttnnnaccanaaacggncttggaataaacnttttcaagggttcttntaaagaanaattcgnaaaantnttaacccccaattttttttttttttaanntgaaagacnccncttntgttncccaggttggnagtttcccnttccgntgcccnngccttangnnaacttttttggaggggganactcntntgacttttnnnccnngggntnnncctttnnttncctngcccnntttcntntttttgacntttttntgngcnntncanggcnttnaannccnntgacccccttcnaantncatnggngggaaacnggggntaannggcatangctcttttatttaagaaagcaccccnnnaatccccctaaacttttcttnaattnacccttttngggacccctctaggncngcttnnntgntttaccnngntccnccaaanttncnaacttggnaaacnntnttgnaantccngggggaatataggnacctttggaatttttaaanncancctnanttggcnngccctttgggcctttanaaanct

SEQ ID NO: 4475 - DNA, 714 bp, Homo sapiens
  misc_feature (1)...(714): n = A,T,C or G
gngnntntatagcangctcttgttctttttgcaggatccctcgattcgaattcggcacgaggtcaaggctcagtcgccagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtctttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcaaangctcagattgtaatatgtaaatggtatgtcattcgctactatgatttaatttgaaatatggncttttggttatgaaaacttttgcagcacacttgaaaagctgnctgtggatcattgng

SEQ ID NO: 4476 - DNA, 786 bp, Homo sapiens
  misc_feature (1)...(786): n = A,T,C or G
ggttcancgaatgcctgtggaanccgcccttctctncagnagcccntcgatncgtnntgaactatcaactagatcngggaagatagaacaggcntttttnncatngcctcgttnacaaagngtcatcacgaaaagtgttcctctaggaaggcataatatgtggccngatggatgtgatgagtagattgtaaaagggttgggattctggcagaacangaanagatnactnaattattggaatcaactgagaaaagagnncattagcatgcnggctaatagaccctaatanaacngggtgtgaaaagatgggatctggacctagaggcagtcttagagccataatnctngatttctncttnnngngaaagcgacaggtacttntggnctgaggccataaatcagntntatcctaaatggaaaactatatnccactggggatggtaatcaccctttngataagaaagggtagaanccacaatcttcaacagaaatggaacttatcaatntaattnaagaatcctcaacagtacanttttaaggnnatggaaccccctgtgnnaancccangttccnactgccanngcctnancaatcctattatnactgattagcnnganaaaagaangcngcancccnttncnaatttttcntttancnncnggnantncccntgaaaggtaanccccttntnaaagggggaaattcnaccnnanggaggcnnnnnggcnnggngaaattnnccttgaaccccccnaggcanaaangttgcttnttanccccagancc

SEQ ID NO: 4477 - DNA, 723 bp, Homo sapiens
  misc_feature (1)...(723): n = A,T,C or G
gcgntctaatgnnngctcttgttctttttgcaggatcccatcgattcgaattcggcacgaggaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctgctcactcagacccggaagacctgccccatttgcaagcagcctgttcatcggggtcctggggacgaagaccaagaggaagaaactcaagggcaagaggagggtgatgaaggggagccaagggaccacccttgctcaaaaaggaccccacttttgggttctagccccactctttccaccttctttgggtcctttagccccagctnccctttggtttttcctggggcctttnaacagatcccccactgtccccttccttttnccctgtaatcctggnctaataaccccccacaacttacacctttgggggacc

SEQ ID NO: 4478 - DNA, 764 bp, Homo sapiens
  misc_feature (1)...(764): n = A,T,C or G
naatagcagctcttgttctttttgcggatccctcgattcgaattcggcacgaggctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttntctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtcccgagactgggtctgtcacctgggcattttcaaagaggacattttggaagaatttgcatattcagatttttaaaatgcacttaacatacttcattacagaattcttgggtagggangatgggataggccanggatgggatggaatcagtctgcctgggaacttaatnccgaatcatttanccttctggattaacccttggncng

SEQ ID NO: 4479 - DNA, 836 bp, Homo sapiens
  misc_feature (1)...(836): n = A,T,C or G
gaggaaatcagtacgctgaggggccaagtgggaggccaggtcaagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccactgggcgatgtgcgagctgatagtgagcggcagaatcaggagtaccagcggctcatggacatcaagtcgcggctggagcaggagattgccacctaccgcacctgctcgagggacaggaagatcactacaacaatttgtctgcctncaaggtcctcttgaggcagcangctctggggcttnttgctgtccttttggagggtgtcttcttgggtanaagggatggggaaaggaaagggacccttaccccccggntntttttcttgaccttgccaattaaaaaatttttggtnccaagggaaaaaaaaaaaaaaaaaaaactccanncctnttaaaactattagtgaggtcgtattaccttggaatccnganattgataagaatcnnttgatganttttgggncaaaccnccactttnaatgcccnggaaaaaaaatgctttntttgggnaa

SEQ ID NO: 4480 - DNA, 1174 bp, Homo sapiens
  misc_feature (1)...(1174): n = A,T,C or G
ttttttnccctttnaaaaaaantttggggccccnttttttntttttccttnaaaaantttnggggnccccttttttttttnnttnnnntgggncntatngggnaaattccccccccnaattcctgttaattttttccgggcccgggaaaaaaggtttccnttttcngggggtttccccccncgggccnaacntttccgggtttttccntttcgggaaatttcctttccggggggttnccgggaaaccccnttttncccaaaaaggttttcccccaagnaaattccccgggcaaaccggnaaaaanggggttccccnaaaaggntttccccaaaagggttccccctttnnggnttncggggggttccttttnccaaagaaatcctttcnggtttttccggncngggggttcccaaaggggttcncccnggggttcttttggggtnccaaagggnaagttcccttttcccccaaagtggttcccaaaaagaaagggggaaatcncnaantccaaagnggtcgccgatcgaagagtncccccaagtctcctgaagaggaaggagcggtgtcctcttaagaaaatgatgtatcggcaagcagtgtaaacggaggacttggggaaaaaggaccacatagtccatcgaagaagagtncttggaacaagcaactggctattgaaaaggttattttgtaacatttgtctaactttttacttgtttaagcttttgcctnagttggcaaacttcattttatgtgccattttgttgctggtattcaaatttcttgtaatttagtgagggtgaacgactttnagatttcattattggatttggatatttgagggtaaaaatttcattttggtatatagtgctgactttttttgtttgaaattnaaacangaattgggtaacctaaattttgtngggncttcctggactttttnaagggaaaaacgttgttggccaggnccntttctacaacnaggccntaaaangcttgttcaaagaagattttggacntcnggggantttggnccntttaantttccttttaaaaatttaaaaaaaccctttccaaaaaagtttnggtgggtaaaaatttggngatattggggttantttttacccttttcnnnaatcttttaaaatnnggggtaatttttgggaacccccaacn

SEQ ID NO: 4481 - DNA, 860 bp, Homo sapiens
  misc_feature (1)...(860): n = A,T,C or G
nctnacacngnncagatngcaccaccttatggnactncacacatntngngnntaattgcctnnaatttgnnnaangggatngcctagtgntncntgnctncagaagggaaagtggnntanatagaaaangacanccnnggctatatacacttaanngngtnatagaannnggctactgaagtcnnngacttntannattnaaancctaaatcacttnttgtnggacggttttcatntacctgccanatatacagcccannaccnatngntggngtgaggnatnnntgtgccgggnttctntntnanttctaacacccnnagttgccataaanntactccggnntattttgnntgctcncaaacttgattttttttttcttaaccaccgcttganttagtggtcctcnattnnggntnnagaaggatncccacntgaaaggngatnaactggtcgnnccanaacanttgtgtggntctctgtcacttttcaagnccatntagtttnctaananccgcggggtattccnctttccnngcctattttttttnccntganaacattcngtnantttanaatcngggggaangaccccctttnaanaaactgngcccctaantgttggtttncacttncncggacgnnttnttttccaaaaaagnttgctttccccncnttccanaaaggaacnaattnttcttaaanaancttctnntcncctcggggaagaaggcccaagngcctttgggaaaccncaagggggacccccnnccntggacaactnannaacnnnttccnggngcccaaacctcttnanttggcntnncccnggtccttanaacananaaangggcgganntnt

SEQ ID NO: 4482 - DNA, 1407 bp, Homo sapiens
  misc_feature (1)...(1407): n = A,T,C or G
ntttccaaaatagcttgggnaaactccnagagcnatttagnganactttgaaancctttggaaannccnaannattnnaaaanaanacngnnannntttnnncaganaannnancanaaannnnacnnngggttttttctaaanaacncncnangatacaaatgagaaganaatnnaaaaaaaaagannnnnntnannaattnnatnaaanacngagtgnaanngaaacgcnnnaaaaaaaaaacanatattaaanaaantttannnaaanaagngnaaaannacacatnntcnaaaancnananantnnaancnanananntntatatcanctanntnantannnaaacntatnatnaanttntanatancnanatgnannaaacagnaacnnatannnnnaanaatgnatatgtnntaacnatataantntnttaganaganatgatanntntaaatnnnnnactatatanataagaatatatnacagagcncctncacanatgatacactgancnnatnntanantcaanngtggactntnngantataananggannacanactagacnatnnntngaaaaganaaatngngganacanannagnttacganatnananacagncnnatanncnanntntgtcananatanatagtancnancaaagaanatggannnnacgacanntnccgtacatcnagacgntcttactatacatacnagagngagancacnnncnacactntgcntnnnaacatntgtannanntanatanatanaatacacacnagccnncatatattacacgnagantgagnncnctacgtanantatatatanncatcnngaananatntnacangtatacncgtanacntacagagtcatnacacgtaantctagtnatctnttnangaacantnttaanangatatnattnnaaangatatnagantctacgtangcgcgnaantnaatntacacatcnanatatagacnanacgtgatntnananatganatactatganaacnnntcnnaacactnacatatntatanaaatacataagagtanacatncacaancacatacagagananaannacacanaananatacataatnaananantcatgantanacttaatcacgnaaaanttannaagcnattnaacganngaacangntacntatacggntanaatacncataaantancanctananaannaaagnnnnnntnncacanannactnaancatgacgatanataacangnatctcaatantnagacntatgaacaaaantagacgaanagtaatatatatcnntagatnantanannaacgagaccactgaacntntnnanatatntaanacatnaactacaatancacacc

SEQ ID NO: 4483 - DNA, 755 bp, Homo sapiens
  misc_feature (1)...(755): n = A,T,C or G
gcgacgcgccganggnaaaaccccnaggcggannncaaggacgcggagncggcacgaggngagagagatcangccgcacgggccncttnannnccccccncgncgnaanncagcaggcgggnccagtgtgcnctgcatccncacccgngaggccgacgacactatcanncccacnnataggnggaggagacagaggcacagagcgcccaaagccccacagcnggcgagcggcagggcnagcgagcgangnccactagacnggngacagacgcagaagccgcgcannncacccccgggaacnggaagacaacnccngacgagcgagacccaggagaacgcacagncnagccagaaaangncnngcaaccgcanacangcancngacagaaangcgacngcccacggaaaaagcgagcaacggaacnaagagaccaacnagcngccgggggcaagggaancgggcancnnggcgncanacnaagaccgaancgggaagccggacccaaccccaaaacggccaaaggggacanaccacaaacagggnancccaaaaacaccaaanncnanncacaanccgaaggaaaaggccgaaaccaaggcccgaggncanggngagcaccaacngaagccaaaccgggncaganncaaacccgnaancacccaggaggcancaggccggccccnggggganccaggcaaggnncccgggnaaaanccccagnnccnngcccccnggnnccangggggaaaccccg

SEQ ID NO: 4484 - DNA, 1273 bp, Homo sapiens
  misc_feature (1)...(1273): n = A,T,C or G
anggnnnnnnnnnnnnnnnnnnagtttnnnnnnnnnnntttttttncccnaaaaaaattngggccctttnnttttccaaaaaaatggggccctttttgggggncaaatttttttncagannnncnnnangttttttggaaaaanncccccttttttggggnaaaacnnnnnnnggnnnnnnnnnnnnnnnnnnangnnnggggnnnnanannnnggnnnnnnangggnnnnnnattntttngnannnggnnnnnntnnnangngnnnnnntnnnanannntnnnnnngnnnnnnngggngnnnnttnnntnnangggnggggnannnnngnanannnnnnggnngggnnnnnnnngnnggggannnnnanatannnnnannngngnnnnnnnnanntnnnngaatggnnaannnnnnntaaggggnaacnnnngngcnnaaaannannangaggggaggaangnacngaaancnnagaggtanngaanaaaatcgcacgggaacntgggaaacnaaannatcnannncttaacnaanatntaaagnaacanaaagcnnngnancanngnntgnnctgttagnagatctcnngnaacaatttntaaanggatnaaatctnnangnaagagnagctnngaanngnanangaaaangaannnnnaaacngangannacanataaacnaagngnaaggtnnctggantanaagaggatnaagaacgtngaaancannaancanananaactngatgcccanctgagnttnnaacnnattatnncaangaaaantgncntacatcanattgggaanatctaagcntcanaaaanaattnnagnanagnatncctnngtatanaaactnngatnctnngnacgaagctataanaataannggaannnnncataanngnannaannaaataatntatnntggtnngngncntatanntaagnaanggcatacaagatnatataaganaagntactatnaanatncntngggaagngantcnacacactantntntncccnntggangnnatnagatnanncnanttnngnntancncnnctgtcatnntnaaagaaangttnanacaganatcctcganatananaaagncaaagacanaggnannacaaacttngcnnannncaaangtcacttcgtantnnacatngnaatancanatnatnnnnanacnncgnaangcacaaaangtanananacatnnataaaaanntngnatgntcgacngnagaangctccncn

SEQ ID NO: 4485 - DNA, 1240 bp, Homo sapiens
  misc_feature (1)...(1240): n = A,T,C or G
agggnnnnnnnnnnnnnnnnnnngagggtngnnnnnnnnnnnttttttttncccnaaaaaaantgggnccccctttnnnntgccaaaaaaaaatngcccccnttttgggggcnaaaanatcngggcccaaancccccaangcnntttannaanccggnnggnttttcccctngggtngggccccagggnaaaannggaaaaaaggtntnaaaaaaaaatnacctntgggcctttaaaagggaaaaaagggggggnaggggggggggnggttggggggggaaagggggggtngggtnangggggaagggaagggggnaaaggggggnaggggggaaaaacngnnnnnnnngncgggggaaanaangcnnnncnannnnnnnaaannnnnncnnnncnncccnnnnnnnccannnannnnagagccncnggnnnnnnanaancacannnnaggccgcccngcnnacgnaaggggccngggcangaaaaangaaaacagcnanncanncncntgantgcatnccgcactgaaagganggncaaacacnggangaggnnnnnntccnaaganncaagggcaaatnaaggaccntgggnncnntnggacacntaaagnaantgnancggatgnctnccanatgacagagangactgggnngcangggnnatgatnaaaagtaacccanngaagaaacgngnnnnannaccngataanncgntngcaanctnganaacggcngaaccnnnnncacnagcannnnncncnangcanaanaancnatangaaaanngggnnntanagggggggntncncacanaaaanggacntatgnganagcnggncaccananncnaaancnaaangggggnantgaacnatangggggcnggnnnnanaggggcnanngngnancanatanannccntngngggggcnagtaanananccnggagcncggncanccanaaannnccgccanaanccaggcanncaannnnccnngngannnccagccnatnncanganggantnaaanaggnancgngcaaagagccnacganagcaanngnnacnatnnantcanngaaacggcnnaaacnnnagagncgaatcancgacacgggcaaacantnaatagacaancacaanncangtnngngagaagtaacnccggctncatncaaaacnnccncgcntacccaaanngnacntccannnnnnnaanaaanacngtgcncgacc

SEQ ID NO: 4486 - DNA, 1444 bp, Homo sapiens
  misc_feature (1)...(1444): n = A,T,C or G
nnanaananantaantnantnanannannnnganaannnannaanannnnannncnnnnnannnnaanannaannatnnnanganannanaaaananataaanannaannanaanaaanganannnnannnagangnnannnaaannatcnaannannnanngannaagnnannnncnnatannaagagnaagggnnatnannaaagggggagcnnaaanangnganngnggaanatnggangnannnantnaaaannnnanananananggggagagttcctaaaggttgggnaaaaacncacnncncaaaaaaagacgagnaatgggcantggannaaaactatcactaangnnaccannncacaantnannnggtnncaacactaannnantnnnantnctangnganganattaancnntnnnnnnnttnnnaatctancatcncncantanntancnnnatnaanntcnnanctaancannnnannnagannncnattgaaaaattanaatatncacnatancaaannaacancnantaatnnaanaannaannnnaagananngccaancatcnanagncnanaannacaatcgnaacntaancancnattanttatntnncaaanganattaannacnngctntatntaaaactacatantctnaanncnaatantatntaatnnatntanacacanatcanagnagnaaaannagntaanaaacntctnngactantaanatatctaactncacaaaagataaaatcannacgtatacganttatnganannactcnacaaantctatnannaaangnntcacanagtancntnaanaanantnnaacatnagagcatngccacaangtatannaatataaantagtancacantatnnctcannnaacatatnnatanngntatnntggagctanannagtctnannnnanagacacatnnncanaatanntatatnnaaananaacaatangtncntgatnnannncnacncacncacanatacantncatnaanacattnacacaanntannanaatcacanctaacatctcatnnatacnannntccttcacatannntcnnactatntantcactnnaaaaacataanannanggacaactnnacncnctaatntaccanatnncatanangatanatagancnanaacaaanattagaantanatanaaaatttaaacgantcatanaaatattnnaannanacacatancncancaatannaactacnattanatcatnacanaantantcgaccataaananacataaatantatnannaanatnannntaaggccanncanattaaatcacatatatntatatanatnanaatgncagaagatatananncnataactaaaantanacatntaatantcnctatnng

SEQ ID NO: 4487 - DNA, 1390 bp, Homo sapiens
  misc_feature (1)...(1390): n = A,T,C or G
ggnnnnnnnnnnnnnnngnanggtttnnnnnnnncccctttttttttgccnaaaaaaaaattngccccctttttnnttgccctaaaaaaattgggnccctttttggggnnaaaantttttttcccgnnnngnnnnaaannttttttnnnaaannnnnnnntttttnnnnnnnnannnnnnagggnnnngnncnnnnnnncttnnnnnnnnnnnnntnnnnnnnnnnnnnnnntggnnnatttttttttnnnnnnngnctatnggnnngnanannnnnnnnnnnnnnannnnnnnnnnngnggggganantntntattntannnngnannntnnnngagggnnnnnnnntantnggnngncganngnnnngatnaannntggcnntgnnggnnnnanatatnanatnanntnngncannnaatnngnnnannnnnnannagggggggcggcannnacaancanttaagctaanaaattncnantnanntgctgaantgaangaacatncanannttaacannnctgnanggctanntgaagncaanatggcttcaannaangcntnntanggacttanggntacnggntatnaggnacctncttanntnntnctaaccntatctngaacggnctncacctcnnaaattgnactantatnntaaaaannatcatnatnanatntnngganaangctgtcaaaaantnnnnnaancnnnnngganannngtatctanntnnacntggaatgncntaaacctataaaaaannangnnataaaanntcaacnnanannnanacntaaatntanaccntntaaagcncntanacnnatttcgagnncctngacaatanttttaanntcatacaaatgtgnnggganantncntatacacgngggtanantgnacnnnnnatcttgnggtanaagnntnctanagcgntatntnnttagnggnnaanatantntntngaggtatcatgagnntaactctcnnatnnanntcgatntacctcacgtngtgtgnatatnnntncantnnatctctanatncntatanatatcgcanaanatntacancacnnnngtnaatatantnnntannntntacnggantngagctctacagatgttntcgannaanattttanganaaaaataggtacanatanntgngggnactnataaaacnnganggnnnntnntttnnaaaaggnnnnacagnactttcnatnaataggatataactccangagcnactttancccanagatcatntcatacgncgngnaannnnnnctancataagnctnttgagccnatacnngctntatancnacangnatannncatnnggaaagnactctatnangatnnananncgcncanacn

SEQ ID NO: 4488 - DNA, 960 bp, Homo sapiens
  misc_feature (1)...(960): n = A,T,C or G
ttctaatngctngctctcgctctcttggaggntccctcgattcgaattcggcacgaggctcgtgggaggctgaggcaggagaatctcttgaacctaggaggcagatnttgcagtgagccaagattgtgccagcctgggcgacagggtgaggctcttgtctcaaaaaaaaaagtccacatcttcatgaaccctnagactctggagttggggtgtcggcttttttagcccagcttttgtgggaattgccttttgacctattaaagaangaaagtggggtaatgggagtnccagccactcaagagactnggatatccccccccaaaatgggttgggttaccnagcttttgnnccccntnggaaaaatgaaaatctnaaacctntntcanctgggnttttnncntttgccaaanttcattttngngtttttaaanttttttcttaattnaccanttaaaactcccttatttttcccatggttcttncaaggggccccttggggtttnaacangaacnacccagctttngantttttaanaagccangaccattntgggcggaaangaaaaaaccaatggggcaatttggaaatnggtgnccngaagtncccnnnaccaaaatngtttaattttaattattaccncccattccnaaaatttttnaaggaanaaaaaantggnaantttcctttttangggtttcnaaaacccctgggaaattngatttttaaangccncnaaatttaaaaaccctggtttgccaaangttccaaanaaaaatnacatnttacnatcctcttcatacctaatcnctcnactacctcaatncttnntncanatctntcaactnttnannattnccattctngatatccanntnanataacnnatnncncntanaaanntnnttatctnanataatnnttctgcnattcnntctcatccctctnatnctcnnnntnct

SEQ ID NO: 4489 - DNA, 1024 bp, Homo sapiens
  misc_feature (1)...(1024): n = A,T,C or G
aatncnaggctctcgttctttttgcaggatccctcgattcgattcggccgaggattccgagtgtttactaagcctgttgaccctgatgaggttcctggttatgtcactgnaataaagcaaccaatggacctttcatctgtaatcagtaaaattgatctacacaagtatctgactgtgaaagactatttgagagatattgatctaatctgtagtaatgccttngaattcaatccagatagagatnctggagatcgncttattaggcatagagcctgtgctttaangaganactggctatnccnntaatttaaagaaaaaccttttngaaaccttttncngctnnttngnangaaantttcnggaatntttnaaanaaaaaaangnttgnnnncgttcccccnaaaaaattncccccccgnnttttaactnaccnctggtggattgggcccnaaangcccaaaaatttncccctcctttgggttggggnnggatttaaaaaggattccntganccccccgnaggcccngnaaattggganaaaaggctttanaggaacacccccggggttaaccttnccctggtggggncttttggccaaancnancntttccttnggctttcaaaattttgtaaangaaagggganaaaaaattttctngcccaaanaaaaagggttccaaaaaaaccttggggntgacctttttaangggnccacccccnttttnttaaaaaaaaaagcccnnaaangggggaaaggaaatttttttnaaccaaggggggcccaaaanggggattgggnatttaggnccccccggaaaattggccccnttngggaattccncccaaaaaaatttggnnnaaagttgganttccccccanggggaaaaccttcanggaccccaaaggtggttagaatccattnatgggggacccggaaaacncnnggagaagtctttcgggngggaagaaaattnanaaaaccgccaaantgcccnttttnaaagcaaacttggaattgggaaaa

SEQ ID NO: 4490 - DNA, 834 bp, Homo sapiens
  misc_feature (1)...(834): n = A,T,C or G
gnnnnnntnnnnntttcaaatgcttngcantcgcttggnngcaggatcccttnggaagccnttggacgacacgtggcgtnccgctgaattnaagcatattagtcagcggaggaaaagaaactaaccctctagttttaattggacacttctttgctgnngcaatctatgccgngtatnnnngctntaagtcagaaccttggattacaaaacctcgagcncccccagnagtggtgctgtattgtcaaagcgtgntctgtaatatttcctctaatttactcagaaatgaagtatatgggtcattaagcttaaaggggaaccatttgtgaatgaatatttggaacttaccaagtcctaagagacttttggaagaggatatatatagcatagtaccataccacttataaagnggaaactcttggaccaagatttggattaanttggttttgaagntttttggatataaatatgtaaatacatgctttaatttgcaatttaaaatgaaggggntaaataagttagacanttaaaagaaatgattggtaccataaattagtgctaangctgaggagaactacaggnnttcctttggattaaggatttgagangagttggtggggcatgcaaattaaaatggaagaanggaaaaaanaaanaaaaaaaaaacctcggagncctctngaaacccattagcgggggcngnnttaccnnngaancccngnacatnggtnaaggaannccantggnanggaanttnnggggcaaaaaccncccaaccntggaaangccannggggaaaaaaaaaaggccttnaanttnnggggnaaannncgggcc

SEQ ID NO: 4491 - DNA, 940 bp, Homo sapiens
  misc_feature (1)...(940): n = A,T,C or G
gtaggcccggnttaagttttacnnttnaaattttcagccacngantggttccntnncgnccgggnttcttggagggttttttntggattttctnttttcctnncnaccattttcattnccttcatnatttcngngcccnttacntttaaaggttntaccgtccggtatngcntaatggaaggggtaaaatcnggnnaattcatggnttggccattctggcnctgngtnccccntncnnanaggncttnaccnaaccttgatggggncntctacttcccccctaagctttnttgtgccacctngttgnttcttaggtacaaaactattccaaatggtacctgncctggatccntnggccaatggggaccncatgggtaagattctgggtntttttaaccatnaaaaaagngccattaaanatcccggntnaagattncaaaatgntattgggggcttccatgaatgggacttgnggactggaaattctctggggantcaatgnaataatggtnaatgaatgtgaagacctnanaccntgcantacttgganacttcttanacacttgtgccaatttnggatattacctanaatttattttaaaaatgggtttttcntttccttttaagtaaattaaaatttaacccctttaggcctttacctggnnaaaccttntttttttttacccttccanttaaaaccctttaaaaaaanttttttaaaaanttttntttggggaccntntttttttggttaaaaaanaaaatttttagccntttttnanccccccccctnntngaaaaaaannnttnggnaaacttcccngggggncctttttaaaaaaccttttagngggggggnccgaattttacccgtgggaaaccccncnncccttttatnaaagaaancccntttggatggaagnttttgggnncaaaaccc

SEQ ID NO: 4492 - DNA, 840 bp, Homo sapiens
  misc_feature (1)...(840): n = A,T,C or G
taatanctnggctatngttctctttgcaggatccctcgattcgacacccaatggcgggtnacgccggtgcanagggggggcccgggggccctggtggccctgggatggggaaccgcngtggcttccgcggaggtttcggcagtggcatccggggccggggtcgcggccgtggacggggcccggggcccnagccccngacttncngaggcaaagccnaggataangagtggatgcccctcaccaanttgngcccttggtcaaggacatgaagatcaagttcctggaggagatctatctcttcttcctgcctattaggaatcagagancatttgantttttctngggggcctttttcaaagattaaggttttnaaaaaatttnccaatncnnaaacanacccttccggcaacgcaccangttnaaggcatttgttgctatncgggactaacaatggccacctcnggtctgggtgtaaatgctccaaggaagtggnccaccggcatncgtgggggcattattctggccaaanctcttccattcntccccctgccncaaaaggcttacttggggggaacaanattnggcaanccccaaaanttgtncctttgcaaaggtgaacaaggnccattttcgggntnttgtggcttgggttacccccttaatnncttnggaaccccaangggcaacttgggcattntanttttcccgtaacctngtggcccttaaaaaaaaacttntttcattnantggcttggggattccaatgnantggcttacaaactttaaacncccgggggctttcaannttgntcaaaccctttngggnaaaattttgnccnt

SEQ ID NO: 4493 - DNA, 760 bp, Homo sapiens
  misc_feature (1)...(760): n = A,T,C or G
cntttttgaaancccttggctacttgctctttttgcaggatcccatcgattcgaattcggcacgagccaacgtgttaggcctncnnngcacgnnnctnaagctgnttctgaatgagaccnagncncntgaanttncacaagacatccccgngaagactttgaatatgaanactgngtgtgtcnatgngttacnaacaacantatacttctnncntgtnctnatcaatgnnnatngggnaacccttccctaattacacctntnccctacacatacntncccatnnacacacacntgaacacactgangatgtnccctttaagtgtgngtnnaatntgctgcnngnattgaaattnaaatgggattgatnantcaagtgacttgagacctgacagcatctttacactnaancttagacanntatgcnctcatgtgggcagcangttacaatggtacttnagcccacagtntattgctatacttgagttcttaactcanaacatatattntgatttgaatggcatantgtatatatnatttcatgcncttttaaaattatctnanaccnctttnatganatgggcagnatgataantgtctaacacctgggatttaactggataattttgctngaatcttttangttttganctnttcaggacnagttaacagacctcanantgttccaaaggcttaaattgnnaactcnaagccctttttnaaaattnatggagtccaannttacctggganccaggacant

SEQ ID NO: 4494 - DNA, 793 bp, Homo sapiens
  misc_feature (1)...(793): n = A,T,C or G
tnanngtanaagacnncgngnaaagcccatcagccggaangcaaaggncgcgggtggccccaagagngggaggagtgggctgacagaaggcccnnntcccanccgcgcacnggcngacccccaggggctaggatacnggagatgaggaacngganaaggggcncaaagagcacanntgactggnagaggacacagagctgncctncaagcanangaacgaagnncncataccccnggaacctnccccnctccaggctcacaccncnagctccancaanganacctnangcgacaacannnaagnnccctnccccaacctagnccnncagcccnaaangaangaacacagatgaanagccctgaagacancnggngnccacaggnggngcccgangcnccgggtgaaagtngaaganngaccagtaagagggaagaaagaatggctcctccctcanttcagagaanacatcctagtcacaagngcccctaangcacncaaggtctnnganagctacattccctcactgancccagnagaaanacactaccaactgangcaccanctaggattaacaacnagccaagcctccccttncctttcncaaggaaacntcnccccacaagggccnccccaatccagaaaatgcctataaanccctggccaacttccggggaaaggggaccnccnngaagaaacaaattnaaaaanaaaaacnaccgntaataagnaaccggggngaaaaaaggncnaacccnccaaagggcccccgggcaaaaaaaatccccaaggccg

SEQ ID NO: 4495 - DNA, 1487 bp, Homo sapiens
  misc_feature (1)...(1487): n = A,T,C or G
agggggaggggnntttttancncnccccctttagggnggaaaaaaaancccccntttttggggagaaaaaaaggncccccnaanntangggggaganatgnnngaagagggnnanngggnaaagcanaccnaaagngggganannnncngnnaaaaaaangcgnggncaagacagnaaggggggncgagagagnnngcnggggagananaaggggaggntntntgagnnaanggccgaatngacgaaggtncggatgggggncaannangggnganaggggaaaggngnaanggnntacnngngantggnaaangnnnatnnggggganaaaggngantgagncgggcaaaannantannncggatangggnataggtngantgangtggangntancnnagataggcgnagannngaaantgagnatnntgnnacacnatggggnataaggcnnnnanngaanggancaggangangaangggcatantagggcgaangaagaannnnngntaggatggnngnaaaanaaaantgntnnngaaagagaanntgangnaagtgncggagaaggacgaagaataancnatgcggaagnannaaggngnangtnnaaaaggncangaanncagaacatngangncgaaaaagcacaggnnnnanggaagngggtgcnaaggngnaanaagagctatnagggggaaaggaagnggntgngggaannngaaganaaggggaggnaagcaaggaaacgatgnnanaagaanaggntaaacgcaagnaggtatnaanaaaganacaancgangtganaggggaagggngggncacaatgaangangngaatggntaggacgcannaagacntaganganagncaaagacgtagngncaaagganganannnacgcnagngnggagacgtaagggnnangngtnagncnaanagatanggannnngaaaanagggngaggagangtagaaagncgaacagnnnnangngagngtgggngtaganagantnnggaaaaaaggggacgcgtanganaacgnangacgcaangaggaacgaagcnaaanagagnnaggagnananaagcgaggaganaangatnagggagagntgagananaacgaatggncganaagagagagnaggtnngcanngagnagaagancganggaggannagantgacgngnagnngagagaantacacntatnaggnnngagaagataaangcngagaagatnganngngangaganacganagnnatgnaganagnnaanntagnagagagagagngngngagagaaaaangtgagaggagaggnaagangaancgngagnggacaggangagagnnntatgnnnggnnanggganagtgnntntcntgngcnacanncnnatnnggacnacgagatgtgcanaganangnngngnagangnngnntagatagagannanagggnataagagacng

SEQ ID NO: 4496 - DNA, 768 bp, Homo sapiens
  misc_feature (1)...(768): n = A,T,C or G
tnnaggttngnnntgtngggcctnttnncntngttgtaancgctggctngctcgcancannctngctgnngcgaattcggcacgaggtgcattgnggccaatggtggcntntgtagttcctgaacatcagctgggaactgcatatggcttcatgcagtccattcagaatcttgggtnggccatcattnccatcattgntggtatgatactggattctcnggggtatttgtttttggaagtgtncttaattgcctgtgnttctttgtcacttttatctgtggtcttactctattnggtgaatcgtgcccagggtgggaacctaaattatnctgcaagacatagggaagaaataaaattttcccatactgaatganangtncaaatgaatgtgncatgagaatgggcttaacacatcgttggtttgaaaacttncatttttaaaaatttagagtttagtcattagaaaaaataatggactggaaagtnatatgtatatccaaatatacctatttcaaagtgtatttgtgaggcctgttntagcctgtgtcttgtgtattgngtgtcgctaaaganttntacttttacnnngctcatcaacaatgaaagggtttgaaaattgctgtggaacatccacgtganctttttngaaagacagtnaaaaaatggnaaacgtttggagctttctnttgagataatctacatttaggnaatataatcttaagggatacagccctttncctttattcttatnncangaaaaaaaaanct

SEQ ID NO: 4497 - DNA, 718 bp, Homo sapiens
  misc_feature (1)...(718): n = A,T,C or G
gngnctttanatancttgctcttgttctttntgcaggatccctcgattcgagcggccatggccaacttggaggtgaagaaagcattcatgggaccactgaagaaagaccgaattgcaaaggaagaaggagcttaatgccaggaacagattttgcagttggtggggtctcaataaaagttattttccactgaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcanggggaggtgtgggaggttttttaattcgcggccgcggcgccaatgcattgggcccggtacccagcttttgttccctttagtgagggttaattgcgcgcttggcgtaatcatggtcatagctgtttcctgtgtgaaattgttatccgctcacaattcccacaacatacgagccgggagcataaagtgtaaagcctggggtgcctaatgagtgagctaactcacattaattgcgttgcgctcactgcccgctttccantcgggaaacctgtcgtgccactgcattaatgaatcggccaacn

SEQ ID NO: 4498 - DNA, 760 bp, Homo sapiens
  misc_feature (1)...(760): n = A,T,C or G
gnagnccggttcnnangcntnggctnnatccaatgctggctaaagttcnaananctggcaacnccagganncangcgttgcgaattcggcacgaggaggaattacaggtagcaaattatggagttggaggacagtatgaaccccattttgactttgcacggaaagatgagccagatgctttcaaagagctggggacaggaaatagaattgctacatggctgtttnatatgagtgatgtgtctgcaggaggagccactgtttttcctgaagttggagctagtgtttggcccaaaaaaggaactgctgttttctggtataatctgttgccagtgggagaaggagattatagtacacggcatgcagcctgtccagtgctagttgcaacaaatgggtatccaataaatggctccatgaacgtggacaagaattcgaagaccttgtacgttgtcagaattggaatgacaaacaggcttccctttttctcctatnggtgnactcttatgtgctgatatnccatttcctagtcttaactttcaggagtttacaatngctaacactncatgatngattcantcatgaacctcatccatgttcatctgnggcaattgcttaccttgggggntcttttaaaaagtaccacgaaatcatcatattgcattaaaacccttaaaagttctggtgggnatcacagaagacaaggccnaanttnaaagnggaggaattttattatttaaaagaaccttttgggtnggatnaaaan

SEQ ID NO: 4499 - DNA, 799 bp, Homo sapiens
  misc_feature (1)...(799): n = A,T,C or G
ttaagntttttttggttggnntttcnaatnttgccanaaagctgnctactngtnctttccgcannatncnntcgattcgaattcnccacgagctgataggtgccnccnttaagacttttcatagancntangncgganccnncaccttctcnnntgaangatactnacccagggnaatggtgnatgctgtgaacanantggngaaccnctcantntgntaanattactnactaanctcaaaagttaagctnnancncacacnnntatcctacctcntncnctgagnntcangttncacacaaaaggnctnaangccntngatcnacctnattatggacntgntcatcnnaancctaatatnctnctcngtacngtnnatatttncnacnnagcattcnctatcttncatccnntnnccaanctggncnctancttactacttgcacctcnctgtacccaacntttccatccattgnntnncctatcaaactccttcanttatgnccttnanctcncgtaaanacnnatgcnnatcttgagtncanacttttnttgcgccgcngtngctcnntttcttttaccnttggaacccgnataancatgnnttttagaanaatnancaccnggnaccttntnancnctanatatgcnctnnntantgctntgactnntaaactannctcnaanngnncttananccttatnaantnnncccttnatnatagtntcattaanggtantccntttncggatccatttanccctttnccatttttgnncctacntcatttaacnttnn

SEQ ID NO: 4500 - DNA, 794 bp, Homo sapiens
  misc_feature (1)...(794): n = A,T,C or G
ggtgnnttccccctttgaaaccctttanacaagctacttgttctttttgcaggatcccatcgattcgaattcggcacgagctnttntccccctatnaaatttgcaacaatanagggtggagggtaatctntnctntcctatactgccaaagaatgtgaggaagaaatgggactctttggttatttattgatgcgactgtaaattggnncantatttctggagggcaattcggtaaaatgcatcaaaagacttaaaaatacggacgnactttgtgctgngaactntacatctagcanatttctctttaaaaccatatcagagatgcatacaaagaattatatatnaagaanggtgtntaataatgatagctatantaatnaataattganacaatctgaatcccttgcaatnggaggnnaattatgtcttagntataatnaganngtgaatcanccaactgaaaatnctntttgcatatntcaatgtnctaaaaagacacngttgctctatatatgaagtgaanaaangatatggnagcattntatagtactagntntgctntaaantgctnngtaaatatacaaaannnctagaaagaaatatatatancctngtnattgtattttgggggagggatcctgggataantnnntatgntcntngaatcncttctggngtcttcacatttttctaccanngaatttaatcnaatagtaaagttgttggnaaaaantcaaagntnggatttagaaagatncnnttcttgaaaanacctgcttttggtaaatgaaanc

SEQ ID NO: 4501 - DNA, 769 bp, Homo sapiens
  misc_feature (1)...(769): n = A,T,C or G
tggttttttaggtttggntttcnaatnngnctaangctgggctcttgttcttttngcagganccctcgattcgaattcggcacgagatgagaaccagaacaagtctggcagcgaggccggcagtccccggaggccacnaagacagcggtcagatcaggactcagacagtgaccagccatccagaaagagaaggccctncggttctgagcagtctgacaatgaatctgtgcagtcagggagaagccactcaggagtttctgagaacgactctcgcccancttctccaagtgccgaatcagatcacgaatcggagagaggatctgataatgagggttctggccaaggctctggaaatgaatnggaaccagagggatccaacaatgaggcctcanatagaggctcanaacatgggtcagatgatagtgactaggttttatttcatcaataagcttcatctctggaggaaacttttttaatatatgaaagctgtgatcaaaatgtttcacatgtttagtcaattgtgaaatttttcttaangcaattntcttttctatcantttgtatattactaanccccaagagacattttctgtgctagnagtccaatattttgagtctctcntgcanatgagacttattcttttgnngtacaatttcccctatcatatgtgaaaaactgctntntcaaatttancccttatgctanantnattcctacnanannttctncctgntanctgtngctacaannttntattntntttttnnt

SEQ ID NO: 4502 - DNA, 1338 bp, Homo sapiens
  misc_feature (1)...(1338): n = A,T,C or G
agggnngntctttccaccccctttgtttggaaaacccccnttttgaantaccaagcctnactttggtgtnctttttttggncanggnaatcncccaattccgncatctncggnaganagntcccnacacactagccagnacacanatctcatcaccaataacnngttttttatcantatcnncncanncnntcnncncgantntncgnngtangntgtcgacaanttntntncncntntaaannnnncnntntactatnatcnatngtcatcntcancnantnttcntnnctancgnannnnntncncttnnctantctnactnngnnncanntnnnnanatnnnnnctnctannaacancacnnngntatntnacnnntntnacnnttgncnctnanntnnnantnctatncanttncnncattaacatnnncccnatancaannntnaccnatcanatacnttttnnnganacnnannnancnntctncttnccnnntncctaacnntannnantctncngnnntttnaanncttnnntnactnncactactnatacattnntntannggntccannaaactnnagtnnnnccntanactgatnnnnatnnnntncttcnnctattncnnnngtanttnanacnnacnatcatnncttttcatnncncnanttncgnnaatcatntgtantntaanannaantcctannntcgncnctcttcncttnctcgnnnntntatncactnnnatnanntnactaccactnctntatntcataccagantatanatnttnaaatcnnntnntcncnnancnntctctcncnangcnntacgacnnnnantcantttngtncantgaactaantaaaantgtctnttctatatcnncagncnatnntntnataaatactctctcatnnatnntnatnacacatatntntncncattctcctatnatctgnatatnntcgtcncnntctcnganacnnncactctatgatatnntntacncactatatntacnanngtatgntangnnacatanaangcttaaactnnanangnatacgacttcantatcncatataacncctcgntatgcananaatcgnactgttaatgactngtatntcgatacncctctanangcntnngtatacntntnggtcnncanancttcatntacnctngtanttatgntatatatangcacngannncnngnaganatcnantacacccttatannttacnananntatatntctaatnngncctctntnactctcnacgntangnnnnactgntatnttcacacntaantattataatncg

SEQ ID NO: 4503 - DNA, 884 bp, Homo sapiens
  misc_feature (1)...(884): n = A,T,C or G
cncnntctnatgngggnangtnggtctntcctacctctttnagganaccctctcgcctaanancnnggctggggcgaattcggcacnagggaatggatattnggggnggagantanntntnnattncctttaggatcnggcactgtggaggaactttggaaattgtnacntgctcacatgttgnacatgtgtntcggnangcnncaccttncacctatccaggangcncanggcngattatcaataacaataacagacgacttgcccaagtctggatggatgaattcangaatnatcntctatatnattgctccatgngntacaaaggtcncattatnnatatatatcnncnnnanatggacttanacacnaacntcaatgcnaaccttttanntgcancctncanactntanntnctgancntntantnccacnncnntntanctcanagggagananacaaatnnttntagcnnttcnaannctacatatcccagnntcnaaaagagnntgnctannctggaattntttaatggccannggtctggggngtaaatcanngatcantcnttataactgcctacnctnnacnttcncaacattatgaaccntttgctnnncgaantgnnttcccaanncnttaaatcgngnccctntcaccnaatggcntcaaanatgcccaancnancncttnaaaaacgnnctnccccanactttttggngcanttnttgaccccccactnggaantnatttancatcccccnagtctaccccntttnttggaaacccnngcnaaatncaatntggnccccttnnnnaacttnnacaccccccccncnaaancaantgnatttnnncccccnngctcttnccnccnacnnnt

SEQ ID NO: 4504 - DNA, 1050 bp, Homo sapiens
  misc_feature (1)...(1050): n = A,T,C or G
tgggtggctngggggnnnnnnnggnngtttttcttnnnttngtntgggnggnccttttactcgcccctaanatcaganattggggtnnggggggggnntggctcgntacctntgnnttctctnagaatnagtgtnnttgctnnntngtctggggnatttcnccnntttttttctnggggggntntnnnncntngggggggntntcntgngggcncnntgnttgctancctnnnntngtntcnatgntntncnttgntntcnnactttntnttgtnattncttatncactctctncnttncnatatctcatgttgttgnctttcattttncncnaagttcccnntgntcnatntttnttatncnccnnntttntgctntccttttntnntanagtgncactntctngttnttncncntntttacnnannttncttnntanttttnccnttttntttccnnnngctgtnnantngggtncntcngcnttcttctcccgntctttctcaatcgttcctnncttnttctncnttgngnccctgttnnattttnttnntntnccganctcnttacntccntcctngtaattntccctnctaatcgtntgcgcnntntcccttnattnntctttngngatncnttggnatctcnnttccctangtctatntgctntttgttccntanangcncntattntgtgncctctcncgnttgnggttctctgtttgtnnngcnncctgtcctcttaaatnttgtcctntgnttncanngnncntttntanggtctntngncccttnttnaccnactttgtnatntatccgtcnntcggtnagttcnncnnatgtcgtttttntngcnctantgtncctgcttctcntnntgnnnctcnnntcntcggtntcnctatgnngctatgttnnnttntccntntctttccattncngcgnnacccccttttntctactnttnatcttctnatnacctnttntnnnttcntnttagnnttntnncnatcntctngntgttttnctctcnnncccttctnntgngnc

SEQ ID NO: 4505 - DNA, 1421 bp, Homo sapiens
  misc_feature (1)...(1421): n = A,T,C or G
nttgnattgggcggtngagggntgaagggcccctttttcttttttccttaaaatggcttngtggagcanctctnnnntnncctctganacatcagaanatatggggnctncggngcnncnnnntaccaccncantncnatgctagctnccnncgnccncaantctncnngacccnncgnncgcctcttttgttntcngantnnnaacctgtnnancccanntnactctannncntnnngnctntgngcagctggannnnnncnacnnnnaancnngcactagnactnccantnantgnatntctnagacncnnncnctnattcnnttgntctcaagtcnatncntcncnccccncnnccaaccacccncnancacctgnngcccccacnncatncccncancactancanntcctaaccctcancntnncncacncgacnnnctncacatncntntcngcctcctnccncacatnntcctacntttncatnccntcccaanaacttntnctnntcccnacaaacacngcnnnnnnncgctctcnntacncacnncctnnncnntantcnntcganttccccataatnctntnnancnngnttccncnctnnattccctctccctagnactnctctcctccntcnttatcaatcnnncccanccccatcatcccctcnnnncccctcacttccttcntcactcngacactctctntntatcnncacnacntanagctcatatnnccactcncantatnnatcccttcctcnctactcnntatatctcnacacttcnntctcncacntacctnngcgntcncttnctcncacnannntncatttctncactncantntcctattcntcttnnnnncnanatctcacnnnctcttctcgcncctgtcnacannttcncntncncactncctcgnnnatnnnnctncnntntctcnntntnactcatntntcatatacnctatctantatctntncnnctcnntntntctttccncactccntgcnacccctcatcnactcncncntanctcacanntcnctcacnctcancnnccncacctatatcactnccatntctctnctcacgtttacactactcacactcnacntnncatcactcntnnttcnncncntangtcncnnntactntatccactctntctcacatctcnnctacncanacntccncacnatcactcntctacncnctntanctnattaccnntcactctcccctcannaccctcntccgctctnctcatatctccnnngnctcatnttctacatntttcactntatangctcctctcactnnnnnccncactatacgtatatcgaanacaacgtatntnaaacccnactnntatctanactctctccnnctntcccacattntaccttcct

SEQ ID NO: 4506 - DNA, 952 bp, Homo sapiens
  misc_feature (1)...(952): n = A,T,C or G
ncttttttctatagngcnnttnttggggtctttctttccananancgtgtnnctcctcctcncctaaanagnnaggctgtggagnncagaccnccnatatgacacnntanatncttaataannnntgattntntgccagangcnctctgcantgnnacngtnnggggngggtgaacacacnctcntgcacggntatcnagancagncttnactnatnctggactacaatnatgtgagataacacanacattanntnnaannnananactntattcnttnttnactagancgntcctncgatnggaatnccctcctcctnangaaactagcatggatgttcacattcaagtgtggggatnnttatcaatttgctatttnataaaanataccaanntntnccctntncaanataattnncntcngatatatggtccatccatttantgaaangctnttcnccctttcaaaangatacnnatnangncanncccngtngccttacttggctnattaaacnnnanatcantcttgnncagatnggngtnttccaccannnttttncccnaagccttannntacctaacctcnctgntcctccaagctnctaccctttccaaccctcacgcnctntcncaaaacgtccctttnnctactctcnntntttcgaanntcccnaattntaccccattncccnttccccnctagcccntnaattntanccntttncctttatcntcnnctncacttttcgtnctccnctnccctcataccactttttctnnnatcnccaccccgncnntcactactcatcagccccctcaactnctnncncatnanattttnaccncntcantccctttctntnnccnctctntnttttctcgnacancctccactcncntctatcngncnttttccnnnncntntctccganncnnttnctcctcccact

SEQ ID NO: 4507 - DNA, 789 bp, Homo sapiens
  misc_feature (1)...(789): n = A,T,C or G
nagttttttttggtgggnttttncaattccctccttccagccaggatctcntnctntcctnaanaaaaggntgtggcgaattcggcacgaggtgagccccacaggaataaaaaacactgggaaggggtaaccccctcacccccgggagtggcccagggggagagaggctacctgangggaangaagcacaaaanggacccgctgcagactcagggcaaanggaatgccatcngngctgggacctgtgagcactacangaggaaacgcaagcntggtggnactggttccagncacacaggcaaagggcaaaagggttggacactaanccncaaagntacttgggttcctccttcttctnntttgccttttnctgctnctnntncatganctccaagtccctntgnttgcgggcggcagcanaaagcccgtcatttcggcgctttcccttaaccnantcgntctgctttttcatattcttntggcggtcaanctcacgctggttaccgcggttnatggctacngcagcggntccaacctgctccgttacgtnccctttgttctgtcnnacnttncangtcccnccccttntnncaacgtacccacagtccttccttttctccccgccccttcgcgccccgnnagcccngntccccatttgnacaataaaaaagcacctntgattccacgncttcnngccttgaatcccctngtctnttaaanngncnnnaagntcccncaatcctnnaaccnccnncatctgntgaancccnngncctttcccntnngnnt

SEQ ID NO: 4508 - DNA, 1454 bp, Homo sapiens
  misc_feature (1)...(1454): n = A,T,C or G
aggggggnngggggnnntttttnggggnccncccccccttttgtnntggggnaaaaaaaacccccccttttttnggggggggaaaaaaaanggggccnnccgggttngnggggaaagggggntggcngnnggngggggntcgnggggnngngngnngnggtgttgnggngggggggggnngtgtngnggtnggtggnnnaggnnngggaggtgnnggggnngggaccncggngggnggngagngggnggnnntgtngngtggtttttttttncgngngnngggggnnnnaggggagggggacggggggngtgnggtnggcgngntnngtggngggggggggnngtntggntggggcntgggtcgtgngggngcgngtgggngncggcggngantggngttggcngtngngggggtgcncgncgcnngnggnagnggggcgtgggcnnnggcngncgngcacgnggggggcgtggggcngggggncggnngtggtgnngggggcgagngggtggggggggggngnagngggagnaggngggggnnggttgagggagaggggtggggnggnggnnnttntgngggggatgttnggggggcganngcgnngggngggggtggntgtgggnnnngggagngngagtggnggntgggnggtnngggtgnggnggggggtggtgtggtgagcnggcgagnggtgngtgtgngnggggnggnngggggtgngggctgcgtgacgntnngngagagggtggngaggngggngngagtggtnangtgtggngacgtggtgtgtgggtgtnngtntggnttcncgagnngngggnngtgagncgngcntggngnntgtgtngtggagcgtcngngcgtggnggngngnggcngncggnggtgggannatgggngacgnggtggtnngngggtgtgngcgcgnnggtgncggggacgtggnngangggtgagcgncggggggaagggtggtgagttgtganngngngganatgngannnngtgtggtgtngtngngaatgggcgancgnatggngtgcggcgcngtgnggggcgtgtgnggnnnntagggtgnccgaggatggggnngngnnggtgcgggggtgtgggtgtggtggnagngcngacngcnggtgnttngngngngngggctggtcncgtgtggggggacgcggaggtgnngatgcnntgtntgcgtggcggggnnngngcggngcgaggnggcgnanagtggggggtggntggttgtgngggnggtgngggggggnggngggnntgtgcgggggngcggggngcggcgtnggtggtcgggggggggggatggggncgngtggcggggngnnnnggagtgncgacgnngggggcgggnggangggggtnggggtgtgngtgggtgtgggcgcgngcngngggngnggagcgnngggngtcngggnggangggtccg

SEQ ID NO: 4509 - DNA, 895 bp, Homo sapiens
  misc_feature (1)...(895): n = A,T,C or G
tttctaattatcanggngntcgnnactnncnctanananataggccttggngaattcggcacgagaacttcntnaantggtgtnntncaccnttngcaaacaggntntnaagatgtgcnctttgggnntgctntttggnnacatacatgnncnttacngntatctntangnnaactcnanaactntctngaatttgncnacnntgcnatntattgtgtgaagcgctgcactanctcacgtttaccantaanggtnccattnccccatttcattatntnccacttataaggctcaaaagaanttgtccccattccggcccaanacacnctntttagnntgaatggntgaattggcaaancatgaanntcaaaccnattanccgnaactgggcancnatccncaanggccttcntacctggancttgttnaaggtgggaanccnttccttaggttccaaaanttgtancattttacccttggcnnggtcattaatttnattcataacnaagnggtcnattttnttncttnatgaccccatcngtgaaaaaattncctaatccantaaccccaanccntgctcnttaattccaagtccntcngccntnanangaattcnccttnncnanaannctnngatctnntnnnttncaagcangnancnnggccnngcnttngggngaanaaatncccttgnttnaancacanttcnancccaaggtntncaaaaannntcctgnaaatcttntttggcnnnannggtcttttacccntancccnttcccaattgggaatcacttgcaantnganccnngtgccnttagantttggnnnnaaatnggnctaaacctcnttggnnntnttctctnntccgcnnnggacaatccttnncnanacc

SEQ ID NO: 4510 - DNA, 779 bp, Homo sapiens
  misc_feature (1)...(779): n = A,T,C or G
tggtnnnnnnnaggttgggnttttcaattttntctanacnccngnctctcgttctttccgcaacaancnngcggntcgaattcggcacgaggnnncccgcnngatcagntnttctnnnactcantaannacttctgggtnacnggatcaaattgaatctgcntaggctgctgtatntggagganncnngttcgcngnantaaaanctgnncatnnngangnctgancnnttnccnnaaaggntangtccantgnnnctgatcancnncaantacncagncaganatccaaanaccagtnatatatgtnccnttgctcaggggtgtggnccccaatttcnatngagntcnacngcnnnnctcnngaactncntcncnacttcttncanntngtcnngnaanncnttnntncatctnagctggcacatgagagtacccntctgctatgccagaagtatgacaccaccaggtnatagttcctacgaccnttaccactgtgactgattgagtggtgtgagaatgagngactnccatnngattncncatttnccatccatctaggngccactctntnngcatngattnctccctggcnaccnaactctnngantnggatgacttntcntnagantngattcttaanatcnngaanttgatgatnctacttatacngnnattttgnccctncngnaaangcattgaagtnggttanntaaaatagnnaacnaccccanttgccaatttnccaaaaccnccaaagcctnaccccgngangggnnnn

SEQ ID NO: 4511 - DNA, 10 bp, Homo sapiens
  misc_feature (1)...(10): n = A,T,C or G
nnnnnnnnnn

SEQ ID NO: 4512 - DNA, 755 bp, Homo sapiens
  misc_feature (1)...(755): n = A,T,C or G
ngtntatagcttnctaatgcttcntancgaattcggancgagagaagccntgagcagcaaagtctntcgcgacaccctgtacgaggcggtgcgggaagtcctgcacggganccagcgcaagcgccgcaagttcctggaaacggtggagttgcagatcagcttgaagaactntgatccccanaaggacaagcgcttttcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaggaataaaaactggtcaagaagcttggccaagaagtatgatgcgtttttggcctcagagtcttttgatcaagcagattccacgaatcctcggcccaggtttaaataaggcaggaaagttccctttcctgtnacacacaacgaaacatggtggccaaagtggatgangtgaagtncacaatcaagttncaaatgaagaaggtgttatgtctggctgtancttgttggtcacgttgaagatgacnngacgatgaancttggggtataacattcacctggctgtcaacttcttggnggtcaattgcntcaaagaaaaaacttgggcagaaatgttccnggccttatnttntcaagaaccnccatggggcnaagccccaacgccctttntttaaaggcncatttggaattaaattcntntttncccg

SEQ ID NO: 4513 - DNA, 1166 bp, Homo sapiens
  misc_feature (1)...(1166): n = A,T,C or G
ggagnttaccccttnnngaaacccctttatacangctacttgttctttttgcaggatcccatcgattcgaattcggcacgaggctacttgggaggcnagagttttngagaatggccngaacccangaggccgctggatncgggngaagggctgttgnggatantntangatcttgntgaatcccactccangananctannttnatnngaccttntcntannnttantgnttncatatntnactcaanatngcaattggatntattnatgcnncnanntcacttatcacctngatcatntggaaacnaataannatctcnannangatcngtcanttntaatantgnggatcaacnntncctctcntnnngggaatntnancntggtactnacccnntttnntaanaccatcttnnccattnacnnncnanngcnannanannanatntaattnaattnnntntanccaagatccatcnacgttangaattnttccccatngnggaattngcaanaacaatntcnnganctaanaacaattcngccnntnnacaaatcnnntnnanncannanncgccantntaatgntcaantncaaancngcccngcacgnanagatnnatnannnctctnantctctntnanccancccatacnnattcgatancnatnannacntggacntnctctnnatcgtnnnnacgtcatcnctaatancctctcgtcatacgcnntatgacnngncctctaacgcacnaatangngcgatatgatcnanatattaagtctntantagtcgcancnctanannacnatggcgnnatcnanttnaatgtatgcgnccangtaanctncgcgtncncatagntnnanncnctnctccnnannatgancnngtaanatgtntacngnactntctcacgnnattntcntatanagccgcgcanatncnancaantnnantanntcntatnangatnattacntcgcttntncnaccncnaatacncngnatnnanaacatcngcntntgnngtctgngntgannaactcncannnacatntcnatnacacnncgtannnnanctaccagctnntacnntaatgatctcannnnncncacatnanatntatcatntgacntnctaccattnacnnagngaccg

SEQ ID NO: 4514 - DNA, 1185 bp, Homo sapiens
  misc_feature (1)...(1185): n = A,T,C or G
ggnnnnnggggggnnnnnnnnnngnggggngnnngngnggnnnnggttttnggggggggggctnttggttgggaaaaaaaccccccnttttngggggaaaaaaanntgggcccnnnnnnnnnnnnggggggnnnnnnnnnnnggggggngggggnnnnnnnnnngnnnnnnnnccnntggggggggggnnnnnanngggggggnnnnnnncccccnnnnnnggggggggggnnccnnnnnnaannggggggnnccnnncnntttttttttttgggggnnnccnannggggggggnntnnnncccnnnggggganancntttnnnnnnnnggggggggggnnnnnggggnnnnnnnnnnnnnnnggggggggnnnnngnnnnngntnnnnnnnnnnggggnnnnnnnngggngnnnnccnnnttntgnnnannncccnnnnnnnnnnnnnngnntgnntngnnaaannnnnntgggggnnnngggnaacnttnngggggnngggngnnnaannnnnnnnnttnnntnnaaaaagggggggntaggctnggggggggnttaaaannngggngggngggggggggnnnnnntgggncgggnnaannnnnccnntttnggggggnngggnggagggggnngggggggnnntnangggggggggnngnnnnnngnngggggnnnggggggggnnngnngnnngnngggggnaaacggggggggggggggggncgggnnnnnggnnnngggggggggggggngggnannggttgggaccggngggggggggnggngnggggccgggnnnggacnnnggntnnaggngggggcngggnnnggggncngtttgnnanaaaaaaannnaaangtgggggcntntgggacnntgggggggggggggnttncggggggggncccggggcnngggggnnngggggnncnnntggggngggggggntnggggggnnanancgnnngnntngggnaaggggnnggggggggnaaaaaaaanggggggnnngnnnnnnggggggggggaaaannnnggggggggangggggnnnnnggggggggnnnannnnnggggggnnnnncccnnnnnnnnnnggggngggggggnnngnnnnnnnncnngggggnnnnnnnnnngnnnnngnnnnnnnngggggggggnnnnnnnnnttttnngn

SEQ ID NO: 4515 - DNA, 1142 bp, Homo sapiens
  misc_feature (1)...(1142): n = A,T,C or G
ccncanggggcccnaacaanagggnccnccnncttcntgggncagggggaaancccctttttggccnaaaaaacngccctttggggggggaaaggnngggccgggnnccnnggggcccanggggggnccccanaaaaaaaacnnnncccccccncntncccccctnnnnccccnccnnnnaaannaaaaaagggggaacccancnaaggggggggccaanangggggggaaaantntaaaagggggggcncccccaaaaccngggggaaaaaaanncccccaaggggggacccaaaaaaannnnnccnaaacccccntggggaacccaatanccccggggnaaaaccccggggaaaanngnnnnaaaannccngggcccnaaaaagggggcccccccnaaannntnccccacaaaaatnaaaaaggggccacccnttncccgggaggnaanntccaaggggggggacaagggnnantttngccggggggaaaaagggantccacccccccccnaggaaatcaaggggnngcggggaaanagganggcntnacccaaaacccccgggggnacgggngccngccaangaaaaagagaangnantntnnaaacccggggganaaagngnaancncgncgnnannggaagngggggngccccccccaaancaaaangncccccnagggggcccnnaacnggnaacncnnggggnnnaaaggggggccnaaaaggccccggggccccaaananccanacccnnagnnngnnaaacaaannnccaaacccctgggcntntggggggnggcaaaacnaaccccccggangggggaaaaaaaaatangggggnaaaaaggaaaccaaaanctggggccngggcnggnaaanggncgtaaccccccgggaaaaccccaancangncngggggaaanaacaaggcnatgnngcccaccggcggccccangccccaancacccnnntagnntnctcccccnngaanaaannacncgcatcccgggaacccaaaanngggaanagccnncgggggccaaggggnncancggnnangcnccnnccncccgggggncannnccnanacntnccgggcnnnaaccccccaaangaanccggggaaaaanaagggccg

SEQ ID NO: 4516 - DNA, 741 bp, Homo sapiens
  misc_feature (1)...(741): n = A,T,C or G
cacaccncaaangcacnnnaaacnancacnangnccgaaacgacccnnaacgcgcgcgccacnncannnngacgcggnngaannnnccgcgnaaaagacgnagcganaancaanacanagcnnncacaaancaccncncaccccccnccgagtntggaaaccccnangcaaanacccaccccacgnacggcgagggaaacccaaccggggccgcaatntcgncnacncngggnagatancacnaaagnnnnnccaccacttnaattaaacccagcaaaaacaccacacanggacacaggggggggcncaggganggcnacccgcannnnacccacanacaaaccggagncgcgncgccacannacacggngcacnaancaacaccccaaganacnaaagcccncnanggnaanagcccnanaacgannccancnccanacaaccgaacacacnaacgcnacngaacaaaaaccangcnacagagcccancgcanngnaagnaaagcccacacaaanagcacgccngnaacnagaaagcccaacagacnnacaacagaacnnanaagacaaaccccacggcncnncaanagcccacganaccacgnaancgnnacccccaagcanaaagcgagaggaaccnnnncanaaagncgcgaccgcngcggngnganacaaggaaancaannaaaaaaangagancnccncacnagcccaaanaancccgnnanaaccgccnncccg

SEQ ID NO: 4517 - DNA, 753 bp, Homo sapiens
  misc_feature (1)...(753): n = A,T,C or G
ggcanttgntcttttgcngatcnctcgttcgaggacnctcgagagttntcatgtactagnatggtactggctgncnngcgaatatctnngaccaattatnaaanaaatatgtgtagagtaganataaantggtaactagtnnnttatnagaggggaagtnggntggntttataaattaaatgaacatttatgcggtcggttatttnnacgtaaaaatagntgttatattctaggnaacagaaatttagaaacctatttttctgtagaagaaaggtgtcgctatctgctnttgatntctcagatatttgcttctccttagaatgctatgancagatntntattagaatgaagttntctaaaggctttgattggcatgagctnnattacttattngcttangttaangattagcccaatagacatattatctttatggaccattgcaaatttntctaatntctaaccattnttaaccttttatatatgaatnacnnaggaaaccatnnnattattataaagtntattcctggcncnntggaangncactcaatnangtatttgttaattgnagntaaatgatccccagtnngagtagnnacctnncangtttccnnggggaatnctttntctaccnaccgtggggggnttacctctnnaaagattgttttttnggttcccaacttnaccgnggaaaantaccttgggaaacctggnccccctnnagnanaatcntcgntttgggcnccactgatc

SEQ ID NO: 4518 - DNA, 972 bp, Homo sapiens
  misc_feature (1)...(972): n = A,T,C or G
nnnnactananacatncaantnnntcannnacnctcanannnaacannnatacncncnncananatnananatnncntttcaccacananctcactnccntacacannctcnacnactnncnaagnggagggaanntagngantannagagganatngaaangcggcgcacantaatttntaaaggnnggntctntaantncttggntatcgnccctcatgnaggnacccatcgcanncactnngatcnccncacagangttacatanncactgttgcaccagcncagtaactaggtatntnacacctacannactcacangtgcacggntntanngncnacntntaactgctcttcatgcttncanggccctatnnangaaanccaganatnacannncttntactatnacttaccacacanagngaggcnttngctncctaaacnnaatntntatcanacaagcnntccatcaanatntctaantnnangggctaataangaancaagtcnncgtgntgtgtancctnttctccctcancanatacaatacaggagctgatatgcctgggctcaccctgcttaanaacaaggnctcaacnatcngnccatacccctnntattacccnagatgggaaacctctgnanaatgttgncactancctngactctantctctnatatactgcnnctntatngtcaatcncnatntaaaccataanggttcaatagcctataaaaagngcgccngaaattagtatgngnnattnnaggtnanaaactcanntaaangcattcaaatcttcangcctaccatgaccctatttctncccactntaaccaanatgntnactctcanatnggaggacancnccctgcaatnctctcacctccccatncctcaacatnccacccangaaaccanaatgtgntaancctcnttncaacaaaaatngnngnggtaagnaancn

SEQ ID NO: 4519 - DNA, 759 bp, Homo sapiens
  misc_feature (1)...(759): n = A,T,C or G
tnagntttttttgtgggttttctttttactaanngctgggntatcgttctttccgcagnaacccntcgattcgaattcggcacgaggggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctnccaacgccaccttggaacatttctacctgaccagtggcaagcagcccaagcaggtggaagtagagcttttgtcccggcagagcgggctctctggccgccaggtagcgcgttggttccgtcgncgncgcaaccaggaccggcccagtctcctcaagaagttcccgagaagccanctngagattcacattttacctgattgcctttattgccggcatgncccgtcattgtggataaaccctggttctatgacatgaagaaagtttggganggatantnccatacacaacactattcctttcccagnatttggtactacttnatttaacttnt

SEQ ID NO: 4520 - DNA, 841 bp, Homo sapiens
  misc_feature (1)...(841): n = A,T,C or G
gtttttttgnncngnaaacccttggcannnncggancagcggacncggtnntcgnattnggccgagggcattgaaacctccgttcatnatttttcggagttaaanaggcagcantngcgngnntgtacacactnntanacaggnnnnnnnatngacttgacctnntngaatctctaaatcangttccatatggatcgaangnccattatgcnattcanatgcngcccnttctnanggnggtgggnccntcnacccntngtgcncgtgcagaactgannnngacggaccgcctcantcnncncnaacgtgcaanatgtatnnanncaggtgaaggggaacactaaccaagcattgaggtcnnaaaaacagggatnnggtatagtganctncccnganagcaaaagnanntctgctcaccatttcccaggnagctnagaanccgcngattcctgaantcagacacagaatnaannctaccccgnngcaggaanctntcnnttgaaaattttcctnacggngtcnttaccntcttnggcttggggantnantngggcaccaagtaaanntnttntgcncaccnntgggggnaccctttccatctgacccattcnnngctctgtaacttgacangntttnttttccgcnattgggaaagntgnaggggtgctanagccttaaaaatgnaanccccttttttttcttaaaaanaaaaaagtttggtccggcttttattcnattggtngggatggnggggggagganaaccanntaaaggttttttntcnngaatccccnggggagtggnnccncccgantttttttgggttcaaaannctttccct

SEQ ID NO: 4521 - DNA, 938 bp, Homo sapiens
  misc_feature (1)...(938): n = A,T,C or G
gnnncnnnttctnnaagggggggcagggggggtttccctttctnacagcgagtgaggacgtcnnantcgcccnaaacanaatagggcggggnaatgcaccaccagggacactcagncctccnancggcgggcctngngngaagaagccanngggctgggctgatgnnaatggtagnnnacanngatccctgggggcatcncngaccnnancatacnagtggnannancccntnatnnccttgnnaancntnntgnaggangcanttcactgctccaagaacnctggtgcnaacttgacanannggctccatgccctgnagcccgcatgnatttgccggtnncanacagagcacatccatnggggaaatgggnactnatcnatntgnctngaaaagnagatgccncaatcctgcacancccaccactccccatganacntctgcnnggatcttnagggaccccccgtaactggaaaacncgnggccctgtccccactntaatgcacnangcacnccngaggggnggncntctcactgngcccttgctgnccacnacgccctngaccgnncgccacctgangancgaaaccnnagccngcaaccccnngtnncccancaccggcancccatccccaagcaannncctncncccccccctttannnnccaaatcgntcccacctnanntnaccnntcggcnaaagtccaccgttccnnncanagggcntnncnccnganatggcnnnatnnaacacctngaantctnngancnnaacnnnncttccccaaananctttnagcccttngccaccccnncctngggggaancncncctncggctcaaagcctaccttgnnaattncggncaannaggcccccngnntnttccnnncatactngcntccccnnnggggcccatnnccgaccncaaaaggggcct

SEQ ID NO: 4522 - DNA, 1128 bp, Homo sapiens
  misc_feature (1)...(1128): n = A,T,C or G
gctccacagagcggntttctnacngcaaccggacgccgngnaaccccnggngccgnaaaggaagggnggggcgnagggcgcncnncggccgnccngaacgggncacganacagtttttttncnaacacngacnccgaaaanatgcnnngagngctntncnantnnnancnnagagcgccanacgtngcacaaangcngncngccnagtggcacccntnncgacantccccnagtntggagacggncnaatgacnanaatnggacccngncnanngacnccncacncacaccnnnagngnngacangangngngcctaanaagnanangcccacnnnntgtgccacnntctangngnntncccaggagnccncanncganacnaaaangccctnngggnccaacnggtggnaccngccaanctngggnanncannaaggangnntcggtaaancctngnaggncngcagnnanacgtcacgcgnggcctcactnnacanccctancancgtnccanntngggntacactctccaaacnacatgagtctcctcnccnaaantctcgggggngnnncnnccccantcatacncancccncgnaaatnaatacaccncgctanatnccggcaanatctgcngcgacaagannnagaccncnctacgactnntanccannctannangggncaaaacggngcncncncagnaagacnccggcanntncaanacancncncattnnanannggctnactctnagaanacntcctnnaanctcanctcacccttnccttgctntcacgnggcatnnacactacattnagngggntcacactcttcaaaaggnctccctggncncccntngaaatgcancnactcttcncnanngnntntccnagcaaaccaanagntcaaaccnctaaccananctncnntcccctggcctggncccctttaaanntgganaccantcncctatngncnncggggaaaaacccncntagcccacaaaannangctnggtgaagnnnaatggaaagnctatnctcaagnaaatcccacctatttaanaataancngnccccgganccnaatntggccccttaantnccactccntngnnacccggc

SEQ ID NO: 4523 - DNA, 876 bp, Homo sapiens
  misc_feature (1)...(876): n = A,T,C or G
gnattatnggcctaaatnnttgaagnttggtgatnctgcntnggggatngtngttncnggcaagcccatgtgtgtacnaaagcttctccnactatncgccttgncggncaacaannttnnttgagataaaacaannactttncgnagngtgtcaaatanagctgcggacnagaatgnnnttncanctgncnatgncncctgcatatgctcnaaaagacncnganaggganntgnnttttctcctttgtnccgtgcctcnnacttttagtcnctggnggaagganccnacncnatantgctaaantgcattggcnanttgaaggtnaggtagcaaacgactncctanatgataanggtccngttannnaaancttcngtnggacncnanggtgnantnanggctcnnttnggccttancttnacgngctagnngnacntccganttattnggnncttcatntcaggggnttgctttanngngacagntagaccgaagattggaaanngannttggtggncccattgnncntactnnngttgttccgnnanannctggnangnttgantnggtnggacnantttgnacccnnttggttttgngaccaatcngngcaaacaatggcaaaaatccncttcnttttcttnaaananntaanaattcttanggttcctggggggcctccctctttctgcnccaacctttcnccaattannctttacgntgggntnctnttcaccaaaaaccnttgggganggtcccaancnccnnggggaggncaaaanaancccccattggcccnccnnacctattttgccnnggtnnacgaannattctancttttaannaanncnatnttttnatttnttttcngaacc

SEQ ID NO: 4524 - DNA, 806 bp, Homo sapiens
  misc_feature (1)...(806): n = A,T,C or G
gtgntttctaatgcttctaatngcttggctactcgttctttntgcaggatcccatcgattcgaattcggcacgagganntctntgctatngaacagnggctggtnnacactnngganttannnntgnacnntannnattgnancanntantactggnnntccntaatncnnttaatgtnacntnttgcaagnngnnctgatnaaatacacgacaggagggaaanctantgcgtcataggcacaggcagacctaccgnntaaggagatnatntnccnnanggntggctgttgagnncatgcaactctggnatgtatttccctttataggaccaccttgtncatngtggataaagcccctaaagnaggatgnnaaagatgatcngatccaatacgttacnctgacannaaannntgtnatacntcngctgancaatctntccancnnntntaatatcgtgnatcacctagggtgtatgatcntaggaactctgcncctncantcnggactgtccatcacngactnntgggctnctactgtacantangcgnagaanancnntcannctacanntaaccagattggtgctgnnanatggtantgcnntttnancncccacgacncaataaagnncnnctntnccccanancctntnnagggaagaaaggaattttncatagtgggctcaatgaanggggtacccttggnctttntaaaaaacgttncatggnncctaccttaaacctgngtnaactnanancnnttngncataangggtctaacgnctatanggggnacnnatttttnc

SEQ ID NO: 4525 - DNA, 760 bp, Homo sapiens
  misc_feature (1)...(760): n = A,T,C or G
ggnnttctaatgctttctaataccttggctctngctctttctgcaggatcccatcgattcgaattcggcacgaggaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtattacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtntttttttttctttttggatgtgaaggtgaacattcctgatttttngtctgatgtgaaaaagccttggtattttacattttgaaaattcaaanaagcttaatataaaagtttgcattctactcangaaaaagcatcttcttggatatgtcttaaaatgtatttctgtcctctatacanaaaagttcttaaattgatttttacagtctggaatgcttggatgntttaaaatantaacattttatattttttaaaagacaaancttatattnatcctng

SEQ ID NO: 4526 - DNA, 1236 bp, Homo sapiens
  misc_feature (1)...(1236): n = A,T,C or G
tttgttggngtttggntnngggtgggggcttnttnttaangnntgntntaaatcggtgnganagnccctaanatngaatagggttngggnccatncnnttntcntntacnnnnnncncntatgcggnnnnnngcctcannngnacttttttanatnattttttnncctcgnnanngntntactcancgtnntgttntgntnctantccaanatacatggatntgcccnntactnnnnacnntacaggngctngcccngncnngttcnannnattancnnaccanntnntcntnnttncnganagagtnctgcnnttcntgaaatgttancgccnctcgaacacnntnntatcnctanctngttctcttgtctnntcctntanatgantcngancttttnaatngagtncctaatctcnanngntcttttngatcntntggtctttgcntancttnnaacntccttttgnttangnananaanccttcntaaattnanncaanttnnnttcctnnctaagnanngnnccttantnntntncttnnantaccctnancnttnttcnancnnatcnttcnccacngtntntaantnnantnnatttcnaantncctnncntcaacnacntcaantacancntcctctcnanctatcacaanncaanngncactaanncgtactatttctnctanggntccncgctatttnttccnacttnctnccaanannatannntanaanatnntccttctaacnttncggctantctcatctctnncttanntnnnntcagcgacanatnnnncnctncatatanatnnctcangtannaanttctntatntntnccctnananacacnntctntnnaanttcttcnntntcttantnnnatantttcnntntnttannnatacnaactantntncntnnttntnatntnnnatatccacctntannnncantntncnatanntctnattnaatcncnttctacancctannnnntcnnccntttnntattcnctttctgngnaatatatcnatattctnctntannnaatttntttctntcnctctncantataatattttnggggnntntctnatnatntnctctntaatttttncnnnntncnnttannaaaccttggngaaattaatctcntantcatntatnctnnnggnnatgtacacccaanttnggttnannttntnttcttcantnntaannngnn

SEQ ID NO: 4527 - DNA, 752 bp, Homo sapiens
  misc_feature (1)...(752): n = A,T,C or G
tgnttctaatanttgctacttgttctttttgcaggatcccttttgacgnctttggcacgagaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctnttgtggcatagaaaaagtnttaagctcaantagtttttttattattattattattaaaagttattcaggactgatgtgactncngatttnagaacatgtggtaatagtntant

SEQ ID NO: 4528 - DNA, 752 bp, Homo sapiens; identical to SEQ ID NO: 4527
  misc_feature (1)...(752): n = A,T,C or G

SEQ ID NO: 4529 - DNA, 1017 bp, Homo sapiens
  misc_feature (1)...(1017): n = A,T,C or G
gntttcgaatgctgggagagccgatngnggctggnnngcgcccaannaagccctttgggaaaganccgngcgngttgggngagnngccanggggnagnaaaggannnngngnggaggngngggggngccncngtttagngacagacncnggggagaaaacgggggcgcgagcncggagagcggggngannatgnaggggancggnnagnnnnnacagcngaaagggncngnaaggnggagnntaaggggnncnggncncnanacncgagngtangggcnngncagagccgcngaaganagcganncgggaggcncgggnngnggggggcatggccgngnnnnngnggnagccnagtnagcgggnagagggnangggcgcggggggagnngacgnggggangccnngcgganggaatagnagggggagggcnngngagggggncggngagggggannccnngcgnnggggnnagnngacgnganacgagngnggccggggancgggaggnngggggnccnnggggccggnacnggganggggaggngngnggggangggangggggggcanccggnacnggnnggggngnggggggcaggnggnangaggcgngaggnccgcgggngnnngggggaanngggangngggggggnccnngggnggngngggagngagaggggganaggggggngagccngggnnnncagggngnanagggnnggngnnnaggnggcgnnggggaggagngngggagnganaaaagnganngncggggnnnncgggggngnnggagancagnngggggggcngcgngaaggaaagggcggnnnagaggngcgcnggggggncnncggggagnncnggacncnnggnggggcnnannganaagggnnggggngnggnnggannngnnggncggggngnncgcggngngngggggggnggngggnacncnggnagngnnngngggggcncagngaggggnnacacncncggggggnnagnnnnncgggcgcg

SEQ ID NO: 4530 - DNA, 810 bp, Homo sapiens
  misc_feature (1)...(810): n = A,T,C or G
ggaaagggggngnnntttctaaaggngcttttcaaatncttggctactcgnctctangtaggatcccatcgatgcggaattgggccacnangnnaggnagggnntgcangctgggngtntcactgatacangcacgcgngtatgcaaaggaaggaagggagcttaatgccangaacagatnttgcagttggtggggtctcaataaangttattttccactgaaaaaaaaanaanaaaaactngggcctctagaactatagtgagtcgtattacgtanatccanacatgataagatacattgatgagtttggacaaaccacaactanaatgcaangaaaaaaatgctttatttgtnaaatnngtgatgctattgctttatttgnaaccattataagctgcaataaacaagttaacaacaacanttgcattcattttatgtttcaggttcanggggaggtgtgggaggtttttaaattcgcggcccgcggcgccaatgcatngggcccggtacccagcttttgttccctttagtgagggttaaattgccgcgcttggcgtaatcatggtcatangctgnttcctgtgtgaaattggttatcccgcttcacaattttcacaccanccattaccgagcccgggaagccataaaagtggtnaaagccctggggggtgcccttaaattgaagtgaagcttaacntccacaatttaaatttgccgtttgcngcttnaacttggccccgtttttccaattcggggaaaaaccttgtncgtnncccaacctgcctttnaattgnaatccnggccnnacc

SEQ ID NO: 4531 - DNA, 814 bp, Homo sapiens
  misc_feature (1)...(814): n = A,T,C or G
ntgngggggtgagggtctacnatnnagnggggctncncntgctctccgnancagnccggcggngncgaattcggcacgagccaagnaatacctnggtaaatnttctaacctnatantgtatncagggttnatggctcatttagnttgagagtgttaagagactggagttttaatccaatangngtgccttttggttctcagatatacatacaagctgtgattgtttagatgtttccatctttttatatatgcatatacatattattattggtgttntttattttnaggaactgaaagaaaatggtgaattgctgcctatnctgagaggagaaaattaataaatcttaaacttggtgcccaactattgtnagaaatatctaattacattgggagcagntcatgatntagtcctcagaaatggactaggaatagaaaattcctgctntctcagatacatgttctgtgtatttncaatgtcgngctaaatnaatgtatgttacattttttttcccnccanaaaaaataannaaaaaactcngagcctcttananctatagcgagtcgtattncggnacnatccagacatgataagataccnttgatnagtntggnccaaccnnacctagaatgcaantgnaaaaaangccttatttcccgnaaattttgngancgcntnttngcnnnaatttnntaacccntttttaannccgccaaattaanccnantttnacccaacnnnnccnaatttggcnattcccntntctnacngnttttccaaggcttccaannnggtcggnaagntctttnngaaant

SEQ ID NO: 4532 - DNA, 782 bp, Homo sapiens
  misc_feature (1)...(782): n = A,T,C or G
ngaagngnnnnnnnnnngtnggctntctaatnctngcnaanngctggtctactngnnntntccncantatccctnctacacgaatccngcacgagcnatgatgnanatcganatnnactctngttgatgtatatattttattnacactggaacagctcacncnctcancntcttgcctcannacctggatngatnnccggccncatatgagcaacttcattgcagaantcacctgtaggcctgacagcctnaaanagtnccctttattaganagtantntgncnacttctgatctgtnatctttatgtnaagcatgtntattntgnacancatatacttngantnctctgncctacngcatattctaatgtncctangnntataaattggngtgtccagancanccnnnttaaatttangccngttntattaataattgancctagatctnntctaatcctaaaatnaatcnatgtattncctgacctgntntttattcaatctgtttatgggaaagcatcatgcancctttacaaattatntnntcacctctncacngcnagctttctnnntcnnnnaagtnngggctatctgantatngtccgcatcccttgacnnnctagntntccnttnaattatcnctggatacactgtggngcctagttaaannnccatncctttcnangtggaatngnggnaaagcgcctnnnggggancatggantttcacaaagcctcgaangtcccacgcctngacgaatgcaaattccnangnttgtttnn

SEQ ID NO: 4533 - DNA, 867 bp, Homo sapiens
  misc_feature (1)...(867): n = A,T,C or G
nttttcnnngttgggngnnnngnnggggtttctaatgtngctaatggccgtggctactcgttcttnccgcacgcagnncggngnttcgaattcggcacgaggtcctnntnnttttnttngnngctgggnggnaactctntattnnantgtccggnagaaggatgggngtgngaacanggtggncnctgtgcnngctncagctttcactccggnngggntcnatgctgtcnnggnccgcacgnactgccangnncacanncctggcctcccgaggcangcacagcaagtgtgacgggactggaagccntttncacgaccttgnatgngctggtcacgtcacagtcantggntgccactctacaggctgttggggatggntnancaggggnacactgtgcatnactaacagncacctgngtatgtgntgcntanatcccgggnctggnnnaacctccngctgntcccatgcaccacaagactgccantgtnganttgcntgantccttnctgcnnnttttccancnatganaanctcctccctgcggttcncnggaccngtgnaanantcccgaagccccttngcatggcntnggnttgtggaccnncccggcctttnancnggccntcnccctanacggcttgntanccccnnttctacnatcccnggctcnttcnncnntttcnttcataaaccgcctgcgtccttncacngtcggnttnctcggggnccntncctctcnntggggngnttccccnccctcctcaaccctttngnccccctggattntacctanngntcccttnaaattctnnnccaacggccccnctncccnccgcccnngncttncnccgtntnactnacnncct

SEQ ID NO: 4534 - DNA, 1038 bp, Homo sapiens
  misc_feature (1)...(1038): n = A,T,C or G
nccccttnctgtagnccnnnccanngngnctttctaatcnnggngnggcgctgganatccnaaanagacnngccgggcnanttnggggcgaggngnggngggggctgnnttgnnctnnaaantgnnngtatcagnacnttcnacgcntcngancccgncnccatantangggccnngnanaccctggccaacanntngcnccaccatgnctnnncccnccttgacattntnacnaccnnnctgaancnntccncnctnccctaccctaccaccncgtgctcnanntacangcttnagnnnctncgcctagncntgncnnccntntatcncnanagngactaactcnnnttnnaccagnannnnacnncncnactctgcctnccatcggtnancctanntctactcnacgatacnncnttnaccntcatcacatcattctctccctgatnnntnagtnncccaaactacncgcccnacacgnctgtgcnttggtnccccaaacnncnncatgnccnnnaaantcttncncncnctnngccannccaccnccnaaccctnaccntatttcctntctccctncnaanaaacgttaaaccnccctaaaanatnccccctatccccnnaaancncntaccacctcnncggcncccacccccncctcgnngacanaanatctaccttccgncacnacaaacccatcctccanttncncncacnacnaatntncaactttanntcnaacctnnnccntnctanntcccccttccncanncccccatttncctttcaaaanctcccttancccnaacntctccccctcctaactaatatcntcctcttgcacantcnaccntctaatcatcncaccactnnncatncactccttcaatataccntttctcttcnnaaaanttcncctntncncanattcctntcnnttctaactctctcntctctctccctnnancacntctctctcancggtctatnccacttcnctntncnctactctcntccncanctccaaannccacccct

SEQ ID NO: 4535 - DNA, 932 bp, Homo sapiens
  misc_feature (1)...(932): n = A,T,C or G
tccccaaaaaaagaatcattnggttttggaaaagaatacnnantcagnaactnttcnggtgtgtggtgaaaatgtcaccgtgtgtggnataccctatctcctggctacaagacctgattgaaaangaacagtgtccttacaccagtggaanatgagtgcatcaaagactttgatgaaanggantntcangagttgnatgagctgcagaagaagttaaatattaacatttccctggaccataagagacctttgattaaagttttngggaattancnttagatgtgatgcaggctanagatgaaattgaggccgatgatcaagagaagatntgattggccaaaagaaccaggaatcccggnccagattcgtnttnantgantttataggnatggcancnttnatggacnaataaacacttcttcatttgtttnttaacnaaantgtncccnnttttgaaactcnttngggatgccanaggggaggnnaaacnntaagncctgtttcccccaaaaccngnantanancggtnngtganaatatntataattggtngtcctttgnnttctcttcnngngngngcanaaananattntttggncnntgcgntgtgngcnccctttcnaaaatcttttgattngcggagngngnnannnnctctaantgnntttccgtccctttgacncngaanntttgtgggnntttgggggccattatnataanttttttntnagntcggtggnaaaaatagntcnccttctngnnaaaanatacnttccttnaggntntnaaaaacccnanntaagnnngcggttanaaanntgtnaannactagagnntnnngnatncttnttgttntatntannnnnnngnttngncnggntnaaanttnngccnctncnnattttantnttatntaatccttntnnggannn

SEQ ID NO: 4536 - DNA, 836 bp, Homo sapiens
  misc_feature (1)...(836): n = A,T,C or G
atacactgaccttgcccgctcatctgcgagatgaccctgcaggaataccactatgtccaggagaaggcttccaagctagctgctgcctggcttactcctggccctctacatgaagaagctcggatactgggttcccttcctggagcattacagtggctacagtatctctgagcttcaccccttggtcagacagctgaacaaactgctgactttcanttcttacgatagtctcaaggctgtgtattacaagtattctcacccggtcttctttgaagtcgccaaaatncctgccttggatatgttgaagctggaggagattttgaactgtgattgtgaggctcacggcctggtactctacancagccacagggctaagcatgcatgttaacagggtatatttattctatgttcgaatttgtcttttgatcgctcanattcattttncctttnnttgcttttcccaaactgnnaatggtataaatatctatgtngcttggttttatgaaaggaaannaaattggcanatttgactncaaatttaattanaaaattnatgggttattggttaaaaaaaaaaaaaaaaaaaaaaactcgancccttttaaaactataaagaggtcgnaatanccgggggnggcnggaccatgganaacaaacatttncctgaagntncgggccaaaccncaacgtngnatggcaatngnaaaaaaaannccttnttttgggaaaanttggggangcaaatgcttttattgccancnttttnaaactgccaataaacaagtttaccccccncaatngctttcantttatgttttnnggtccngggggagggn

SEQ ID NO: 4537 - DNA, 1039 bp, Homo sapiens; identical to SEQ ID NO: 4465
  misc_feature (1)...(1039): n = A,T,C or G

SEQ ID NO: 4538 - DNA, 743 bp, Homo sapiens
  misc_feature (1)...(743): n = A,T,C or G
ctnnncctccttgatccnttcctnctttgaanncatnngctacttgttctttttgcaggatcccatcgattcgaattcggcacgaggctgacctacatcagaagctgctggatgcagnaaagtgaaaacagaccaaaacaacacngggcgaatcttnacaccattntgggtgccnnatntnnccnnngatatttgcttgctnagctctactcctccaaganannangnntcaaacnctncagcangntagagcanntnaagaccgcntntnctnacctnctnaagannctctgngaggancgcaatcctttngtggaanatagaatcaacagaccacactgcnctctggaccatgngctctcaaangngctagaaggtgctgaccttttnagactcttgcagaagaggcgangtggtgnganaccctnnaggaanactttcccgaactagaccncnncttncngaacnngntcaactgttggggnngaaancntgtganntgtngnccttcngagagacggcatattctatgatggcngacttnatncttctgcggaaccanactngacntactgaaagaaanctganaccaagcgtcttccttaaggacccttatatccagacnatcctttggataataccnctnggccaaaacctnntaactntgcatacaatcnggatggcaacatttgaactggnggccttnannaccnttaccggcttttcncattatgnaagagntn

SEQ ID NO: 4539 - DNA, 849 bp, Homo sapiens
  misc_feature (1)...(849): n = A,T,C or G
cccnctattgccnncnacatggggnttttccaccccgntcacgtggtggncgcccanncgnacnagcangagcctacnantcggaacatatcgcctttatngtctttaacanaganntnnntnnntagntcnattcanttatnacccagcagatccttaatnnaggcccntatattncttacctnattagaactntnnncaaanntcaactgnntnaccttaatgnntngnagcacntntnacagnngnacttaaaactntanaatntcntnagnnncngttattctccactgaaggnctntccactgtncaccatttcangcatcatcactatgattctttcancangactntggcncggnttgncactgatctntnnccnaatggcnaacnagctgnatnntcnnttggnctcncttataggaacnancaacactagcctactgnatcatgatntccganaactgaaccatgaacactgccatctnnccatgntacctgcatnaagaanttcacntcactctgaaacatannatgactgacntgganctnactaattnctgagaactgnnnntcaaannacccacttaatngggntcancatnttgnnacncttgnaatntaanntnannnaaagaccnnnnttgantngcccncattttannttngnccataataanngngccacnnncctnaanntcttcaancangnaaaagnttngcaacttnttacnacctctncttccccnctnnatctaanatncnnnatataccacttancccagaatanctacncccaanccanncantcaccnccccacnattttatctcacanttccncantccct

SEQ ID NO: 4540 - DNA, 777 bp, Homo sapiens
  misc_feature (1)...(777): n = A,T,C or G
gnnnnnncnncnnntgggngnttgtgggggntttnnaatgttgcnaaaangcctggctactcgttctttccgcaananccntcggttcgaattcggcacgagggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacanagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtnaaaggcctacaagcccagattgccagctctgggttgaccgtggaggtagatgcccccaaatctcaggacctnccaagatcatggcngacatccnggcccaatatgacgagctggctcngaagaaccganaggagctagacaagtactggtctcagcagatttgaggagagcaccaccagtggttaccacacagtctgctgagggttggagctgctgagacacgcttcacagagcttgngacgtncagtccaatc

SEQ ID NO: 4541 - DNA, 890 bp, Homo sapiens
  misc_feature (1)...(890): n = A,T,C or G
anttttancttgaccccttcaannangatgaacataaagctcttacgttcttgaaaggatnaaacacaagaataagatggggtnccagtgaccagctcctctacctggggtcatggaggaccgaagaccctccaaccttgatgcctgtaaggacaggcgctnctgtaagggatcaggtgtaaagaatctggccatagctcctgtacaaagcctctttgtctgaagtacttgggtgctctttgacggcaagagggaacacaacctgtccgtggctgcttggacctcaccacgggggctcaagtggacataacatctatttgacaggccctggcantcaccantggggtgtgtgtggcagtngctgtggggtgtgagaatgactgccaacaggcacttctcaacaaatgacctngctgtttnacattggccctgaaccagggangaaagnagagggaccaattggaagcctttgttnccancatttccttcttaaaaaaggggaganacaattttaaaggcacngttgttatggaatttgggaattaaaagcaggaggcttcaaagggtgggtttcttganntnaaaggaacacaancccgnngggggcttttgnngggttcnacccannagnccttcccttggggcanganancacncaatttngtnncctnattgccatcnnatttatttgcccccttttttnantannttggttncccaagaaattaaatnnntggtnttattaaattcattttgttngctttnttttttggttcgggaaagntntttgcntananaccccccccaaaagaataattgaattgggggtnccccttgcancctatttgatttnttttaangccctgtnaaaaangncttccccancccnt

SEQ ID NO: 4542 - DNA, 770 bp, Homo sapiens
  misc_feature (1)...(770): n = A,T,C or G
ngggntccnttttngaaaggnctctctttnaagacccttgctacttgntcttttngcaggnatcccatcgantcgaattcggnncgaggntggccagganggtctnaatcctgancctcangaggnggnggantgagttnnagaanngcctgtcgnanggagatttgggtagaagccctcatgctgagctttgtgtccctggtgatgttggaacattaatgatggaacatggccaaacttcagtcatgatcctgaaaccatggcttcaggatcatgactgacgtcatggtttcttccctgccagaaatgaaggttcagttatgaggcaaccctctagtaaggcattgtaaaagttactggatttggtttaataaaagttgaaataaagtnanataanatnaaanaaaaaactngagcctntanaactatagngagtcntattacntactatccagacatgataagatacattgatgagttttggacaaaccacaactagaaatgcagtgaaaaaaangctttatttgtgaaatattgtgatgcctattgccttnatttgtacncattnttaagctgccatanacaagttatncaaccaccnanttgcnttcatttttatgttttcatngtncatgnnggaggntttgggtaggttttttaatttcncngcctntngctcccantngnattngggccccggntcccnancttttngttccctttacttgngggggtaaatgccnccctttggngnnannnatggnnctacc

SEQ ID NO: 4543 - DNA, 861 bp, Homo sapiens
  misc_feature (1)...(861): n = A,T,C or G
tngntntnnnnaaagnngntctnctctanagntgannntgntgntgaacccactntcccgcannaancnngcgngncgaattcggcacgagcctantacngtagncttggagcatcacgattttttnnnangcntgcatcagtatactggaggacctnctngcnctgcnggacanagacgtccnacagaatnnngaaaacngtgctcaggactanannctgaccaacacncgtgcacanaagcaaggaantagggcngganancnantncngnggcntncagctctgncncgcannatnngntanctnntgacttancgtganancaatgaaggnnctnaaccaaagtncccanggggacatnganaaatagcacnangggccttgtatnggacnntacncnntnccnaacntggntncggggntgnnaccntgggaaaggagccttctgcatnnncnnncgccntacccatgancnccnctntaccanggctntgccccctgagccaancncgctgggtntgctgcnaangnaanaancnanntctncagatatggacntaaccntgcaaatntanaanncttgccaatttcnattttgccangatccgncnannccacaatncctcctnnaanagaatccnccacnccccncnagaacctcngnaaaacattnnggncnccncctnngnagctacaattnnctctcancctaggancacncnntcgctatgcncccnncttaccaancctanttcnntcgnancttacccnnntttacccntnnggcatttcccccnnaccnttgnatttnannnatttcccttcnngganatgcaattctcntgngcacccaacaacc

SEQ ID NO: 4544 - DNA, 813 bp, Homo sapiens
  misc_feature (1)...(813): n = A,T,C or G
tgtgngtgcttaagcagattgctatgatgcatgtccataaaacagntttctttctgttctattgtggagtttttctggggctggaaaacattcttttgttatttccaaacactgtctataattaccagacatgatataaacacataaggtgccaactggaatttactctagaggggactttccctctcagacttccagtcaactcacacttgtgcaacaaagtgcatgctgtcccctaaatatgcaagcagaactgtgtttctgcctatttggtatctatagtcctctacagtcacttctagagagactaaaccaaatttctaccaacttcacagggcaacaatcaatagttttatctcaatgactcttgtatcttcagaccttaaactgattcagagaccatggggcccacaaacctaatcaagagtaacgttttcattgagtacacatttcagacatgagaatcttcactttccccttttttctcttggtaaaatgttcacaaaatgtgcaggtaacacctgctggttactncagccattcgggcccctaaatctgcagctcttcattttggatctaggtcttgagaatttgggaaatagaaaaatttttatctaaaaatgcaagtcttttgggttatcaaactcagacattgaaaagaaaagngcagttacgcctttctnctcnttgaaanatgnattcatctnttggaactgggtcacttttggccncaagttgatgtntattaaactggatattccacattggacactggatcttatccctaaaccataatganatatgtccaatcnt

SEQ ID NO: 4545 - DNA, 960 bp, Homo sapiens
  misc_feature (1)...(960): n = A,T,C or G
tgggttttcaggngcccctttnanacggnngcggcctttcgcctnnncgnaanagcccgngcgattcgnagacngcnnganaagtgncnnangtnncttnntnatggtgaggactttatgnanctgangncantncnngncntgantattntcnncnnntggnaagatngcacgtgtnttancctgatgccagntggngntatcccntncncnnnttnttnnttcacggngaacnnnatanatngannagaatggnatcagagaaggatactcactntgctctcacngattagcggcgattngcntgatcncngctgncatgnaacccntatctctgngnttcangcgactgannggtgancaccncccnnctagntgnnacnnatnncactcctnngactntccngcaacntnttntnnctntnagngngtnncngnnnttncaccgnnnnnnccncnnttngnncncatncttttnaccccnnttggcnccacannanctncctttgccataaannctttnntntaccatganngngattncncncttttngnctnnatcncntntnaattcaatncntanncnnttatccnnccntttttcnttgntccnttttnctgngnantngnctgggaanttttggtntccncctanntngaantcngccttaanatcctttgggtggacnttgggcangnttcttctnggggaatccctttttnatggaattggccttnaaggccnnttggtcttccttggcaaccntnggggtnggccntaaaatgggcccctnaanttntttanaatncnncnnnanttactnttttcnncctccaaccnntttacccggttgggctcttaacccccaggntgggaatttcaaaatttttaaggnttccccatttnttggaaaaccttantttngggaccccccatttngggctnccnattttnggaat

SEQ ID NO: 4546 - DNA, 816 bp, Homo sapiens
  misc_feature (1)...(816): n = A,T,C or G
tnttnttggaaaagggcagtgtctctaaacccaggcaaacggtaaatgtggggcatancaagagggccgggtagtggccacttncccatcatgctcgnttctcattttgtgttttttagtagaaaaacacagggtgttcttttgcccagacattaatctttagaatgcctgtnttttctaatgttgggatttctttcacaaccacccaccttaatatttccattgngactcaganaatcagacttcattcgattctntagagaactataaatactgttgtcagtagaagtgaantcttgcttatgtaatcctaattcagaatgtgttctcagaagaggtaggcnnggaccananctgggcnagaccacaggcagaggccaaatccnnccccctgccgntagnagctaatatnagttttacacccacttgttcatgtattttccctggctacttgtgggcagcaatgccagagtcaagtcatcataacaganacagaatggcctggaagctggatttactatttcaacttttacattaaaacttgatgacccctgtgctagacaggcagctcatttctgcnggtaaaattatatttcatcttccaacttttcatttccaaaatttgaacctatattactggaggccccttacnnaagntaaanttttcattnttcttttggggggaaannctncagaaaaanccctnngcccntttaaaaacttnnatgngggtnnnttacccntgtcccacnctggaaggtccntnggggnttngggcaaanccccacnannngtgcccngaaaaaatgctttttt

SEQ ID NO: 4547 - DNA, 785 bp, Homo sapiens
  misc_feature (1)...(785): n = A,T,C or G
taggagtctgaaggcctcgctgctttctgtgatggctttgcagtaagtgccgcctggcctgcatgcattggctaacaggctgcagaatggcacngaaggactcgctcgagattgtcatggccagagatcataggtcacttnaggtagcaagacccctgncaaactgggcacttggcctatgtactgatttgtgggatggtggcaggggtgtggggtccttcaccctgcctgaattctctttggcttctgtgctctgtatgctgctgtccccaagggctctttcttattatggcagngagtggggattggtcctactttctttctctggaaanggaaagcctccaagactccatgtgcttgggcagcttgagaaggcgttcancaccacgcctagcaggcagaccttgaagcctcacctttantntatctgcaagaggtattcanttcctggcacaagggactaggggcatgtanagtatatgacgaggcaatatggctgtgcnggaccttcatttaacttcaattaatagggaaaaattattatactctatagatcctgaaagggttctaagattaaaancatccttattaaaatcttctaaanaantctggaaagaaacacctaatctanaaaaggcttgttnaaaaanccacagngatgggttnttaagaagcaaacnccncagcatttccatttaagtaaaaactaaccaaggcagcttttatttaagaagngtccggccttctaaccctgcacaagccnatgaggacatatggaaaatttt

SEQ ID NO: 4548 - DNA, 734 bp, Homo sapiens
  misc_feature (1)...(734): n = A,T,C or G
gngcagctcttgttcttanagncaggctacttgttctttttgcaggatcccatcgattcgaattcggcccnagctgtgngggacacattcnnactgcggcaggacntgtntgctgnctnatcacnttgacttgtaatagcattaatnntcaagcgattgatntatnataanngncattctagcatngtncatggcngannncntcctggnanatgntaacggtcttgcnanctgatncctctatctgnactgggtctctggcangggcctgatgnatngtanatactcgntangtatcnnttnngttntcnggggntctntcatgnnngnnatnnnagcacccangaggnactacactnncaagaaaaaatggtngnctnntacngagctgtnaagaacnntggaacntgctatcctgangccnctnaacttcatcatgggatgcctancttgtatnnatgttncnttntgnntaaccccatgatctgantntggacactaagancnntgtcatnggctgaggnggctntgaagngnactcntaattatgacnctgggatntaaacggtgctcacattgtcttgnanggnantttttcaaaaanggatttncgccttttggncccntgggaatttaataggcaanaagttttggccntaattgccananganganancctggantgctaangaacggcnctnttgcctcnnggatggncccctaacttnaaggg

SEQ ID NO: 4549 - DNA, 621 bp, Homo sapiens; identical to SEQ ID NO: 3863
  misc_feature (1)...(621): n = A,T,C or G

SEQ ID NO: 4550 - DNA, 971 bp, Homo sapiens
  misc_feature (1)...(971): n = A,T,C or G
nccncttntntntagggngntngtgggggttttcnaatntnngctaatgctgggctcntgnnctttntgcaggtatcccatcgattcgagngatgcactgngantacacgcnctaaaaatcgcagtcctggccanaagacgttatggncattgtgagggactgggggnnttggtcctntttnaggggctgtnnggactcaaatcggtgnctggtttcacacatatgtgttggtttgtggtncaacttctttatctganaacnccagtgataaancattgatgntactgaccaatctaaactaccatcttganagagtngcanctgaaantgatgcgataggcgtgncaagtatctgatnacttctttnangcatacgnnanaantgtatgccngttacncttgnangatacctntgctntnacaggntcagtatntatcagtnngnacacaaacacatgaacacattcngatanggcttatttcacacagttgaagttgatgatcntcccctggagtgctctgntanatatgncncngcctntangggnaaaanaaccccacactgcttctntgaccaccccnagcntntntnncnntantaatatttcntncannngngnaacgtnnncnaccgcctnnaatncctnnccntcgnaggnnaaaancccanttnaanancgncattnnnttgcactccccctcnnnnactcaactnaccnacactgggcncaannccctngnnncacaaccnctttntnttntctcacngggaatcggcaatnctgcactttcctatccctggncttaaaaaanattanatctccggnctctatcnnttgtaagntcacnantcntcctcnntancaaancnanacnncnannttttnncaaatccttcntnncnccncannncnnggngcacantntnncngtgncnnaactcntnggggcnnatntntcncnccnctnt

SEQ ID NO: 4551 - DNA, 791 bp, Homo sapiens
  misc_feature (1)...(791): n = A,T,C or G
tttgaaaacccnttttntttnaatccttttctttcaaatggttctngttctttttgcaggatcccatcgattcgccaatggatgcaggnaaaactgagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctgggattacaagcatgggccaccacncctggctaattttgtatttttagtagagacggagtttctccatgttggtcaggctggtctcgaactaccgacctcaggtgatccacccacctcggcctcccacagtgctgggattacaagcatgagccaccgcgcccggcctncctgttccagttttctataatctgttcatattatattctgggtatatgtgggtggtgtgattatccatgtggtcttattttcacattctttgcattaactataatgtcttaatgntttaagataaagtttcattctacaaagatgtattgtaccaataacctgggtattcaggttaccaatcttaaaaaaaacttanttcattttnaaaattaaacnttaaaatttnccaattccatttnaacattaan

SEQ ID NO: 4552 - DNA, 761 bp, Homo sapiens
  misc_feature (1)...(761): n = A,T,C or G
tcnttcagttattcgttcagctccttgntctttttgcaggatccctcgattcgctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaagaaaagaaattgtcctttggttgccttagttccagagttgaatgaatgtacacattcngtagtggggggggcagaccggataccccttccttgtctggttcctttgaaaaaggacctccacctttcaaaggtacttaaagccatcttttacagattgcttgtaatgtaagggaaaagaagtcattgtnctttgggattggattggagggnaaaatcatcaaccactagcccccttttcaaaatcagcgaagatatttngatgattaagtgattcattgggtatgttctggctactgatgttactgaaatctgcaatcgngtatgntttttaattagttgcttttgtatttgaatttatgacatttcgaagtttctgngcttaactctttttaattaattttctgcacgtngcttttttctctttggttttaattccatacagagtattcaattcttgaaaacacattaaaaataatttgcttgcaaaaaaaaaaaaaaaaaaaaactcgaacctttanaactatagtgagtcgtnttaccgtanatcccagaccntngtaaaattaaaaaaaaaat

SEQ ID NO: 4553 - DNA, 1281 bp, Homo sapiens
  misc_feature (1)...(1281): n = A,T,C or G
attttttaaantttnggggnnaaaaattttttcttttttttgggtccnaaanattctttccggnccattggcccccttgggcccnaggggnttnccgggaaaccttccnttnaggnnnngggggaaatccccccccggggggnggtttaaccccnggaaaggccctncgggnaaaaattttccgacccccnttaatnaagnttnttttttttcnntttnntttaacaaaattttccnacttggggncccggttccggtttttttaaacnaaaacggntccgggnggaacttgggggaaaaaaaccccntngggnggtttaccccaaactttaaaatnggnccttnggcaagcaacaattccccttttcngccagcttgggcggtaaaaaacgaaaaaggcccgnanccgaatcgcctttccaaacagtggccaancctngaatgggaaanggnccccccctgtaccngnaccataanccgncgggggtggtgggggtaacccccaaccgtgaacngttaanntggcaagcggccctanggcccgttcctttcngtttctttccttccttttttcggcaacgntanccggcntttccccntcaagnatttaaatcgggggctccntttangggttcngaattaagtggctttaacnggcaacctcgaaccccaaaaaacttggatttangggnggaatggggttcaacggtaantgggggccaatcggncccttggaataagaacggggtttttttnggccccttttggaaccggnttngggaaagtncccaacgggtaacctttttaaaataaagtnggggaaccttcctttgggttttcccaaaaaccttgggnaaaccnaaaccaacntttnaaancccccttaatcntttggggggnccttaatttcnttttttgggnaaattttnaaaatnaaaaagggggggaaaatttttttgggnccccgnaaaatttttccnggggncccctnaaatttggggggggtttaaaaaaaaaaaaaaatgggnaaagnccttgggaaanttttttaaaaaccnaaaaaaaaaaaaattnttgaaaaaccggccccggaaaaanttttttttnaaaaaccccaaaaaaaaaattnggtttttnaaaacccgggccctttttaaaacnaaaattttttttccccctngggaaanggncccngggggnaaaaattttttttttnnatttcnccccnttttttnaaaaaaaaaaaagggggggggnccccccccanaaaaaanttttttt

SEQ ID NO: 4554 - DNA, 916 bp, Homo sapiens
  misc_feature (1)...(916): n = A,T,C or G
tttgaaancatcanctctngttctttntgcaggatcccatcgattcgcagaaagggaaaatatgaagtgcgtgctggggtttgctatcgtatccacaggcatcacggcagtgctgctcgccttgatttttgttctcagaaagagaataaaattgacagttganctttnccaatcacaaataaagccatcagcagggctccctnnctgctgtaccaccccngngaaaattngccaccctaattttnttctggntcctttggnnggntgncngctgaccctgggaactgaagganctgcccatnttatgnanggcgnccaagtgggaatataacccctttncggcattcgggccatgtggccgtaccnttaatttggcctcaatctggactagngaaattatccttggcgngccaacaaaatgactataacttggggcagtnggtncttggttcntttcaaccanaagtnaaaaattaatcctccggaatcaatcccatccttttccgggctctcttccaattcttntttctttntaaccatcaaaggggaaccatttgtggaaaangggncaatttttnaancctcttggggggggagggatttccgaagaaatcaattgggcaatggttaccattgccnaaaaacgccancttggnaaaagnaaacaaagcaattggntggccantttgntccccaanggtaacccttggttttccccgaatggcctggccttaccttggnttgggatttcttnggggnggtccctttggaaccaaaaaaaaacccctngggnttcccaatttnttnnaaaccccccgnaaattggcccnttntttaccctttaccaaaacctnggggtttttttttnaaaatggggggggggggaaaancccccccaaaaaagggggnaaaaant

SEQ ID NO: 4555 - DNA, 791 bp, Homo sapiens
  misc_feature (1)...(791): n = A,T,C or G
gngtctccctttntttgacatcnnttggctctcgctctttttgcaggatcccatcgattcgaattcggcacgagacctgagctagggttgcagcagaaattgagttgcagcttgcccttgtccagacctattttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattantttttattattctcttaaaaatcaaagatgatctctatcactttgccacctgtttgatgtgcantggaaactggttaagccagttgttcatacttcgtttacaaattattaagatancttntttanggatanttttggtaccatatttgtgaaaattttttgnaaaatgccttgntaatgnggntttttnaccncncnaagttattttgtttgcaaaacttnaatggnccattttccctttaanaatnggtttncaccntattttnt

SEQ ID NO: 4556 - DNA, 779 bp, Homo sapiens
  misc_feature (1)...(779): n = A,T,C or G
ttntcnnaaccttcaactcccgtgctnatgcaagatcccatccnattcgaannnggcacgaganacncttaantatacgctacggtntgtgtgtggtgctnnatacncaccatgttacttaatcnctttggtaccnnttncnttttgntggatccaaantgnaaaccgatgtntgntaccngnccnnatggtnttaacactttttaaantgananacattggatcttaaaaccctaagctattgcacancngcatttcacnnccgacgaagcccggtatcccctanacgntggggcactttccntaaattgaagntgncaatnntatgccggnntcnagatataangtgcacncccaaaaacgctttcngncttgtaaactcaacngcatagttangcnngnncntgnccgcnccacatggtgaaacattttncttnaccaagantaaatgnccanggtgcntnttaggnacacttactttctccggnacatccaattaacgntatttgcccgntgctgtgcctgggnagtttttattttatttatttggggttgnaaaagcagnancagagggagctcaatctngtttgaaaccnacgnagtgctnccattgatacgtanatnaatnaaccgccnggnggnntttttcttttttttggncctggaaaatgctgatnccctttgacaanaaaggnanancccccctagccnactaanngtcnccccattntttngggaaanaagggggataaanaacttcccccccnnggnggggagct

SEQ ID NO: 4557 - DNA, 1259 bp, Homo sapiens
  misc_feature (1)...(1259): n = A,T,C or G
tttggaaagcccccttggcagggtgcnccanctgntgnacacccgaaggcncntcccagtttgggttannggacncgcngggngggcngnaagggggagagcnaaacggggganagngtnttntttgngnggcaggagcagggaanaggggggggggggnatnangngcggncnaaccggggaggaggnggggggnngcaggncgnacgacngacganagngggcnannagnnnnggccngcagngnagggangnggatnagnggnncggncgtgnnnnggagnggacgcgngcngantggacgatggaggccnnagnccagaggcngnngnnagnnaggggnnatgangcgcgacganngagcacnggngcnnaggcngcgnngccgnangngcggggagaagcggngngagacnnnaggcggnnccangngannngnggaaacagnggnnngnngagngcgggnancggatgnnncggnngganngggnanggggncaggcgnnnagnnnagcgagggngnngngagngnaggagggannaagcgcggngggncaaggacgnggacgangatntagngngggggaggaggganncgcgnnacggnnacgngtncgagnaaaangacgagggntngngcngtngggagcggcgagggncnaataggagaangggnntaaggngngcagacnncnanngnnaggnnangacnaancagngnngtgncatggcaganggncgncangngggncgggggcancagagacgcgatgagnggnnanagancggngacaggggggggangcaaacgcgggngagcannccagncgngnngggggnantngngnncnggtnaggagngannganngnngcatgagnataggnnngaganagngangnnngggggaaagggaccntaacnnngngnngngcgngncnacgnggcngngggggancccanggnnncnnggagncaaggnngnncngnancngggggngcnagntngggngggngtngnnngcgatnagggnncggcccggngncggnngcngnatcngaacggacaggcgcngnannaggngggcgcnagangngntggagngncacngcggngggnancgngngnncangatggcgaggggacgggtcgcgggnctgacgganagaggcngcnacgnnngaggcgtgaaagaantgnnggncgngggacnncnangagcaanggcaggagggcncggcgngcggnngcngnggccg

SEQ ID NO: 4558 - DNA, 807 bp, Homo sapiens
  misc_feature (1)...(807): n = A,T,C or G
gatntaannttcaccttntgactntntgcaggatcccatcgattcgaattcggcacgaggaaagagatctgacctaaccaactttntcttgccttaacttccaaactgcccttagtcattgatggggcatgggccaacnncnatngggananatctttnttcntcntgnaatnatactcccctttccaaaactaaatgtccttgangnnataacggaangcctcccatngggtgnacaaccgggncggnaantgggctcncnctgtggcatagcanaangntccccggncgtngtggtgnacgntcnanntatccgcnanactcgccattgcnctagcgncnncnactttctttttatnnnctaacattntccttncgggaangcggttttnccggcnttaagctnttaaggatgganggggttnggtttccgnnctnnacnctataaaactctnttaactncaacacngtncnccgtngggaccccctcccantaaagnggggactgnttcacagnganggacccnttttttncncncnncctaatngattttcnccccaccttaatacagttaggaaccccttttccttattccatacaagaacttttttttaaaaaaacttgggancctcttatctacgccttgggngggtcacatcttgtnaatccccaacatttnggggaggctanngncgggaaatatnccttaagcttcaagagttcaagaccagcctggggaaacacttggaaaccgcttctntcnctttacaatttcctgatgccgggatttttcttttngcccttct

SEQ ID NO: 4559 - DNA, 1070 bp, Homo sapiens
  misc_feature (1)...(1070): n = A,T,C or G
tatctatcntcnncatacaagctacttgcangatccctcnattcgttgaaactgaaagccaacttgaaaatggaggtatggcttataattcagctgtgctgaactgtaagtgattaaatactgtttcatcacatatacacatatatatacttatgtgggtatataggtcctggtctcattgacttaaggattttaagtggtggtattggccatatnctgtgggggggaaagctnagaacctcaatanncttaatnaaataggtggctatcatcngttcatttaactcaagcccagaaacaccaaagaagtcaccctcaatttcttcccgcanccccacaatttnaatctaatcggccattttctttaacanggttcccatttttcccaaaaaatatnaaccaatggaggtcccatcctaatttnctgggnttcttaacaagtccantcaaccccntaaggcnttaaagnccaccttacctttcaagttaggcccctcttncccaatttaagggcctttaagtttcaactttcccaagccccccttccctttccnaagtnggttggnanttcnacnaccaagatncccttggccaaggggtaaggttccaattttangaaaaaaccaattanacctttnaagggcccccctgggtccaaatttggccttcttggcntttnaaaaaaaatttttgggtgggggngggggcnttttcccccaattccaattggccctttaangaaaaatnaaaaaaaatccctnggccttttttcnntantttattttttaaaaaaanccaattgggggcttttttgggggngggccttttttaaccaaccaaaantttttaaagttcccttccccatttaattcccctcnttttttcnttaagccccctggnattccttggaaaaggggccaccccatttccccaaaggttttttantngtnggaaccaaaaaaaccaagccaggtnggaaaaccattgggggggggggtttanttgnaaaaccnccttacccgggagggggaaaancccccaaaaaccccccccntttttttttngggccc

SEQ ID NO: 4560 - DNA, 1321 bp, Homo sapiens
  misc_feature (1)...(1321): n = A,T,C or G
acgnaccttcancttccgncttttgcaggatccctcgattcgaattcggcacgagctaatgcactgcacagcatttgcattttgcagatgagtatcatctgggaaaatctgtctcaagatctggccctcccacgggantatgttggaagtaaccaagccttgcccttagangatgcaaccaaaatatttttgggtggatggggtggtgggaaaaaattcttgccaaaaaagaaagggtggatccctgggaaaccaattatttcttctttcaagggggaaagggaagccttggcctggtggttttttngggaaatggtggaaaaagaaccaaaaaaccttatttgaaaagccattggttggaatggaaaaaggtttccttaggaaaaaaaacccattggaaaaantttccaagcccccccttanttgaaaaaattccgccanccttggggttacccanccttggggggaaaaaaaattggaaaaagaaaaaccttttnaaacccttancccatttaaaaaaaaaaatttaggnaanggggggaanccaaggttnccaaaaaaaaaccnttttccaaccaaaggggggggggggggaaaaaaaattcccaaaaggtttttnaaaaaaattttnccaaanaaaggccctttgggggaanttttttaaaggaaattgggaattggnccccccattttttcctttaaagnaaagnaaaaaggnttttttngggccttttttttcctttnccccnaaaattgggccnttcctttaanttggcccccctttttttcctttgggttaaaaaaaaaacccttgggggcccaaaantttttttggggggggaaaaaggcccaatttccaaccnttgggggnaattaaaaaaaattttttaaattttgggnaaaattcctttaanttttccaaaggttcccaaaatttttccccttgggaaggggccnttttttnaaaaaaaaagnccttgggggggaaaaggaaaaaagggttggnaaaaaaccttanttcnttccaattggnaaaagaaaaagnttttanttgncccagaaaaaaaaattccnggggtnggaaaaccttcntttttggccttccttaaaagggcccncccccgttanttaaaaancctttgggaggttttccaaaaccttttcccctgggaattnaccctcccctggaatttttcttaccctggggggnaccaagnaaaaaaaaaanccccttgggnaanggggnccttttttncccnaattaaaaaacccggngggtccaaaatttcccccnttttttttaaaaacncccccccccctt

SEQ ID NO: 4561 - DNA, 1253 bp, Homo sapiens
  misc_feature (1)...(1253): n = A,T,C or G
ttttntacatacttgcttnntacatcncagcactttgggnncttttctctccgagtcngaccgtgtgtgtgtgtgtgtgcgcgcgcgcggcgttctganncttcggtctttgttccggacccggnctccgccgcagccagcccacatgtcgggngatcaaagaaagcaaaaaagacgggtatggctttccaaggccgcccggcttttcccttccncccgcccaacccncaacttggnaccggccnccccttacccccncccaaaccccccccccaaaattttcccccnccnggcccaacctttnggggggttccccccnaaccccccttttccccccccggggttaaangggggggggncccgtttccaggggggnaaggggnaaaggggaaagcttaaaaaaaaaaagttttgggggggggnccaaaccgggggaagggggggggaaaaagccccaaaaggcaaangaaaaaaaaggaaagggggccnttccnttgggtggggttgggggaaaaaatttttccccccccgggggggngcccaaagattcccccntttnnggccccccccccggcccaaatgcccccccccntttttttttccccaancccccccccgggccgggaaacnttttttttgggggggaaaaattncctttggccggnccntttccccttttgggggggngggttaccngccnccggaccggccccccccggnccggaaaaaaaagaaaccccttttccccccggaaagnccttttcntttnaaaaaggttnggggggtttnccccngggaaattcnttatttaaattccccaaagggnaaccccaaaggggggaaccaangggnaaaaaattcccccccctttttttnttttttncccccaaaaanaaaaccntttttttttnccaaaaaaccccccggcccctttttnttccttttcctggtttaanggggtnccttncggggaaaaccnaaaaaattccgaaagnccttgaacnttcccccccgttttccttggcccaaaaggttccttggggtacccccttggggggggnttttttggtttntttnttnggggnaaaaccttttccccttttggggaaagtngggggnccnttttnaaattggaacccgggaccttttttccntttttgnaagggnaaaaaacttggccaaanttttntttcaaaaaaaacccnaaaaacctttggggtnnaaaaaaangggggggggaaaaaaaaaaaana

SEQ ID NO: 4562 - DNA, 760 bp, Homo sapiens
  misc_feature (1)...(760): n = A,T,C or G
tataattaanttgnannccnttnaactcttgttctttttgcaggatcccatcgattcgaattcggcacgaggtgacccttcctgcccttcttgagcagcttgtganccanaagatgtgcctggagagaaagcctcatttggggaagtgcngnattcgaagttctttattttgaaaatgganaacaacccttctnacaaatcctgtctgcccttccccctttncaactagaatatcanntccnctgaacatgaagtnatncacatttcatggaaaactggntgatgntnaanaaatcacttganggcaaactttgtccttcangctgtggntctctgaatngtagagccngcanatcctccantgtatggactgngccttacttgcccattgaatgctttctatacatnaanacttgganctctttacagatgacantnnccagtgnggaagataaaagannagaaaagaccnaaantgcgggnttgccactcttttttgccatcaccgtggggactgcaaangccaatgttggngctggcaaaaagccgaangantaaaggtgctgnantgatgttagctgtgnccactgnggatttttccaanaacatttntanctataaanttcaaagnaaaanaaaaaaananactcgaggcctnttaaaactatattnagtcnttttacctnatncanacttgataanatacattgatgantttgggcaaacccacaactagaaattttcccaanaggggggggna

SEQ ID NO: 4563 - DNA, 890 bp, Homo sapiens
  misc_feature (1)...(890): n = A,T,C or G
tttttnnntttaaantttgnaaaattnnttttttttaccancccctttactccnggtttcctttttttttnggccangggnaatccccccnatnccggaatttnccggaaaattttcccggtttgggcntnggtccggcatatataaaaaccagngngagncccccnactatggannttntnccctngaatataaaaacaacaatccggnggggggaacggaagnagcntggcaattnggnatcgtaataaaaatacggtantcttgaagccccattggatggtcncaangggctggtgtggaagaaccttanttnagcaagaatccctaaaanggggcacanaacctttgnaaagganaaggangttntnttttncaaaaaaaaacccanactttggatgggcaaactttnaaataangggatgaacaatggnccagggcccacccctgggcttaaattancaaaacnttggcctntgnaaagncccngttncccttgggggcttctcttttccttcnatttntggaacccannacttgatgtcnttncaatcgnaactggtttaatggcccnattcctacaaccgcnaaaacttggttcctngaantgtantctgcngnnanaaaaacncctccnnantgaantggccanaaangtantgatcatacacaaananacaccttnaaattntaaccatgaacgcgattatattatgnanaganntcnttcggnnganattatgtnagggagccagantnctcatgctnggaatagngaccnacaaaacntgntcgagggacttattganattaatatggaagatacanngttcntntaccanganntggccacanagaacaatcnatngaccgaaaaatccggggngggn

SEQ ID NO: 4564 - DNA, 791 bp, Homo sapiens; identical to SEQ ID NO: 4551
  misc_feature (1)...(791): n = A,T,C or G

SEQ ID NO: 4565 - DNA, 761 bp, Homo sapiens
  misc_feature (1)...(761): n = A,T,C or G
ttcatttaatcttnccctttggatctntntgcaggatcccatcgattcgtaattatannccctggagttatgcagctaattaaaggtcaaacgcataactttaaagacgccttttcaggaagagattcaagtnttacgcgggtgccactggctttttattatggaatgtatgcatatgctggctggtnttacctnaactatgttactgaagaagtagaaaaccctgaaaaaaccattccccttgcnntatgtatatccatggccattgtcaccattggctatgtgctgacaaatgtgggctactttacgaccattaatgctgaggagctgctgntttcaaatgcanntggcagtgaccttttctgagcggctactgggaaatttctcattagcagatccgatctttgttgccctntcctgcttgggctccatnaacnggggtgtgtgcngctgtctccaggttattctatgttgccgtctctgagagggtnaccttccanaaatnctctccatgattcatgtccgcaagcacactnctctacantggtnttgtttgcaccctttgacaatgataatgctcttntttgggagacctcgacagtcttttnaatttactcaaggttgccaggtggctttttattgggctggcaattgctgggcttgatttatcttngatncaaatgccnanatatgcatcggtccctttcaaaggtgcccctgttcatcccacttttnttttgncttnntttttttnnncnnnt

SEQ ID NO: 4566 - DNA, 787 bp, Homo sapiens
  misc_feature (1)...(787): n = A,T,C or G
gntttnaaatttcctttnncttctaatcctttgcttncacnttggctcttgttctttttgcaggnatcccatcgattcgccaatggatgcagggaaaactgagatgggatttncccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctgggattacaagcatgggccaccacgcctggctaattttgtatttttagtagagacggagtttctccatgttggtcaggctggtctcgaactaccgacctcaggtgatccacccacctcggcctnccacagtgctgggattacaagcatgagccaccgcgcccggcctccctgttcagttttctataatctgntcatattatattctgggtatatgtgggtggtgtgattatccatgtgggcttattttcacattctttgcattaactataatgtacttaatggttttaagataaagttcattctacaaagatgtatgtncaatacctggtntcaggtaacaatctttaaaaaaaacttaattcattttaaaaataaacattaaaattnccantccaatttaaacatnt

SEQ ID NO: 4567 - DNA, 787 bp, Homo sapiens; identical to SEQ ID NO: 4566
  misc_feature (1)...(787): n = A,T,C or G

SEQ ID NO: 4568 - DNA, 762 bp, Homo sapiens
  misc_feature (1)...(762): n = A,T,C or G
tttaaaccttctaatcctttacaactacttgttctttttgcaggatcccatcgattcgaattcggcacgaggaaggacaaaaatatggctatctgantagatgcagaagaggcatttgacaaaatctaaaatattaagtaaagaagattatattagtccattctgacattactataaagaactgtangagagcagccccagtgcttatagataaaactcccatctncctaggacagagcacctggggggaatgggcggctctgggtgcagcttcngcagacttaaatgttcctgcctgccagctcttgaagagagcagcagatcccccagcacagcgctcgagctctgctaagggatggactgcctcctcaagtgggtccctgaccctcatgcctcctgactgggagacacctcccagcaagggttgacagacacctcatacangaagagctccgggtggcatctgccangtgcccctctgggacgaacttccanangaaggaacangtagcaatctttgctgttctgcagcctccgctggtgatacctangcaaacagggtctggagtggacctccagcaaactagagcagaccttcancagangggcctgactgttagaaggaaaactaatgaacagaaaggaatagcatcaacatcaacaaaaaggatgtccaccaagagaccccatcctaaggtcacccaacatcaaagaacaaagatngagaaaatccncgaagtttgaaaagggggaaaaggggga

SEQ ID NO: 4569 - DNA, 785 bp, Homo sapiens
  misc_feature (1)...(785): n = A,T,C or G
ttnnnttnnattccctttttgaactcggttncttgttctctntgcaggatcccatcgattcgttcgagtgcaagctccccatctttcgaaagtttccatggcaatacanctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcanttgtacccaagtatttaaaaatgactctcttaagccttaaaaagtcatagatntgtgctgctgccagaattatattaattattattaatggtattattagaaaaaaaatttctggagtgagaagtaaaaaggcttaattaggttgtgggccantttcatatgctctggtgaaatgtgtcccanatgtnacatagttttttttttaatatgtggaaatgtcttctcttcccattcntttctccctaaaaatcntatattnctggaaatataatgcctctttttaanctcttnttaccttnntaacattttaccccttttcccagttanggnttgcttttttgnccaaaaagnatanccaaattccnnc

SEQ ID NO: 4570 - DNA, 986 bp, Homo sapiens
  misc_feature (1)...(986): n = A,T,C or G
ccgnnntttttngnnnntttttgcaanttnttggaaaaancccccttttttaccaaanancctcncctttgggtttgctttttttttngnccaggggnaatcccccccatgccggnatttaccgnnaaatttnccgggggcccaccggaaggggnnaaaatggggggccccaaaaaagntttnatttaaaattttgggggtccntttttccaaagnaatntttttttttccnatttaatnggggggaccaaagggaaaaaacctggcacccccnaccggaaaatttttattnaaaaaaaatcccccatgggttgggggaaaaaaagggaaatttggaatcccccanaaaatccaaatggttaacctttccaaanaaaaaaatgggtaagaaaaaacttttattaaaagggaagnaannatggnggctttattcttcttcggatggaaaactccantatttttgggtggtanactctatttaaacaatttcggtcataaacacaaagacaaaccatggggtcaaaatgtgtcctttgcttntaaattctgccttcatttacttgaatgacctcagtgcttaggcagtggcctgtgttttagacctggtgatgacagctcccctcacctangagctgagcaccccggccatcttggtgaccacagaaccaaggncacaggcttcanctggtacgccctggggcaggggagaaaattgtgcttgcattcccaagtctgctccacctnctggtgaaggtctgtcgggcctggtcctgtccttggagccaccagcatcctcagacaaagaatctagacggngttgccaatttattaacagcaaataaccaattaaaatggagactattaaatactttattttcccncttanctnaaaaancnaaantttcccccgncnannggnggggcanaccttanagnnccacnaantnnggnngcnggngggnanggnnnnnaaaaaaaatnntcct

SEQ ID NO: 4571 - DNA, 804 bp, Homo sapiens
  misc_feature (1)...(804): n = A,T,C or G
ccgttnatttcgaantttgnaanccctttacaanactacttgtgtgcttgttgtggcagggnaatcccatacggatttcggggaaattcaaaaaaacccaaagnttaccccaggaaaattaatgggtggttttntctttaaagnggtanaaaaattgggaaggggaaacctgggtgggaaaaaaaaaattaaggaaaaagggnggaggggggggtaaaaatccaattttccnttaaaatccttaaaatttaaccccttaaaagccattaagnaataccttggggttaaaataatcctttggggtattaatggntttttttcctggggtcttttggtttttangtctggcatgngattggttttaaccatccttntattagctctctnaatgctgcctatggttatatttccatgntcntatattntactnccatgtaatatatattatncatattacctatattgaaanggaaatgcttatatattcatgtcaangtaatgntatcctctnctgntatgattattatttgcctnaacatnttgattgatttatntaaccctgtgctanattgggaactacttctctnctatagaccttaanannaacatngctttatcaagattttattcagtgatattttaaatgattctgcctgtaggcttgccagacaaattagtgtccaataatctaatgaatgttgnaagtcatgtnggattatgaattccattattttactaatttacttgaaaaacatgattcaaaanattgtttttgttgtttgggttaaaaaaaaaatntaaacc

SEQ ID NO: 4572 - DNA, 793 bp, Homo sapiens
  misc_feature (1)...(793): n = A,T,C or G
gtgaatccttttcnaatngcttggctactcgctctttctgcangatcccatcgattcgaattcggcacgagggcagctagagtcaggaaaatgaccctcatatgctnttnatctttgtttcagttgtctgtcagggttgaattaagaagctactggtttattcccaattgttgatgcctttaggtatgttggaatctttttttttgcctaggaggggccagtngaaaatctgtgactcaagangcagtgaacagaatactgntttctggggaaaaattggttggctacttgatgttaattatggnacagtaacaggaaaaggttgtgtntgtgtttttaagtaatgtctttattctgcttttttgctgctataagagttttctgaaatttatattttaaacttttcatgcactttactgtttctagtctcnaaatgtgatattttnaatcaacaagaaattttccattatgngaatgaaattttaaaagacaatagcctatatttgtgtctcactaatatataaagtataggtcaaatttnaattatttaattagttttaaatatctcaatttgtctnctctttcaaacctgacatnttcngctggtttnttaagtcctaaaatgatgcattttacctttnggncaatttcaattgcctaantttcnntnccatangtnaaattaaanncanggcttattattaangggtaatnattttcccccannaggggtaaatttttaatgggngancaaagngtngntggggattgangtcttttcatnccangnggg

SEQ ID NO: 4573 - DNA, 756 bp, Homo sapiens
  misc_feature (1)...(756): n = A,T,C or G
annatcncttttnattcnatcagctacttgttctttttgcaggatcccatcgattcgaattcggcacgaggtattcttcttctactggagaaggtaccgaaaaagaatttgatcctctgattgcctagggttttgagacatgagaaataatgtctttgatctggttttgagaaattattgcatattttattttaagtgcttgctgcctctgcctttccccttttgctcctcaaatatataaagtaagtagcctgcctacaggaggactgttaaaaatcatatcactagattaaatagaattaaaaaaganacaggaagattgaagatgtagnttaatatatgtatcattaataatagaataaatacaagaacataatgggtgagaaatttatttcttaataaaaatttctgagactagacctttcaacatttagttatacatactttaataaaaatctatcatagtaaatttataatttttggttgagtatgtgaataatccttctgcgcattattggcctgttataaatctttcaatgaattgtgggttggagttaaattcatattgtgctgaatttacaaaatttaacagtttgctntaaacgttttaaaaattntctaacttagcaccaaatccccccatacctttgtgtgtgtgtgtgtgtgtgtgtgtgtgtatgcctgtgganaaaaagtccngagatcttatttctcatttaaaaaangttagcaaaaaaaaaaaatttttttttttnc

SEQ ID NO: 4574 - DNA, 801 bp, Homo sapiens
  misc_feature (1)...(801): n = A,T,C or G
atatncntnataancctttcaactacttgttctttttgcaggatcccatcgattcgcaagagcaagggtggagggggacagattgtntngtccnttaaatgtgtgttgacacacatgggcttcgggttagctggcctgacatggagatagantgccaatgttcccaagcccacagaattatggaggcctcacccncagtattcacagctctcaactggcctttnanaatggaaaccttttctgccntggatatggcgcttcttctgggagaggagcanagccacagagaggtaggaagttgaggcatagcaaagggaangcttcagancttaagcccngntcatctcatatgtgttttctangcctgnggctgaaangaagaggagtggggcancctgggacggnaactgcctctntgggctccccactcccatggaggggctncataanctttgctcctgggctgnatcttganaagngggcanggtcttcccaccantggcanggtgtgcagttgtggtcccaagccttggagggaatggggaatgggctggcaccctgctcaaggaaagcanaagcacacangtgccccaacaggggancttcattgcccccaatanttttaaaaaangcaacccatcacttaaggcttgggtgcccttttcggnaaaaactaccaaacttggaancccctcccggctttaangcccaacnaattttnccctggggnacnttcccttgggaccccccaagggntttcctttaaccaggccaaaaaaaaaaaaaaaaancccncccccn

SEQ ID NO: 4575 - DNA, 895 bp, Homo sapiens
  misc_feature (1)...(895): n = A,T,C or G
cnttnttcnanttatccttcaactcttgttctttttgcaggatcccatcgattcgcagaggctgaggtgggaggatctcttgagcccaggaggttgaggctgcaatgagttgtgattgcaccagngtactctancctagacancagaggaataacctgtntcncacgataangannttcatcanttannnntnataanaattctntcagtgncnngaangnngacacngganctccctnancanganggacatnncnncanggccatnttacgnntcangtgccatacataaagngnatgntggnttgagnttacnaccacactacngaaanatttgcnannanncttatgnnnnatnctttaatnttntccatgtnntgcttccacgcattcagncnatngtgtgggtctnttaaatgnctgnctnatttcttactcaaanggattacnctanatncaacaattntttgaaatggggngcttaatcgattttaatgngaggnnattttacctnatggtcttgganggccacctggnttccttaaagtggccttttgatnnttttaaattccaaanttaggcccntttttaaaataaggtcccaatggnaaaaaantttccttnnaacttttaaacgttnnccttaatttttcttaaagcccccctnaatttnttcaccccngaaggggaanggnaaaatttggggnnggcccattttttattttnggggaaacctggccaagngggatttaanatcgggggggaatcccccncctttttgggaccctggagccaattttggcntttaaccnaaggtntttatccgccccacttttctccaaaaannttaccccccaccangtnttcccaaancctgggggttttttttttntnn

SEQ ID NO: 4576 - DNA, 719 bp, Homo sapiens
  misc_feature (1)...(719): n = A,T,C or G
tatcnnttattctntaacccttgttctttttgcaggatccctcgattcgntnatgtatnaactantcnnatatgttttntancatncttantatccttgcnngcattatgnggattcagggtcaacttntcagactgngagcctgagagttnntctctaagaggctccacacctttnttgtctnttagatcgnggccaaantgagatgaaaactaactcttgagaaanaaaaaccancatgcnttaactgatacaccgtgttgncttgttcatncacagnnnatncagcgantaccaacatccacgntatgaaatgncnccctangtntcttattctagcaactgccnggcaccacaaccatggtaacnttggggagacnnaggtctttcgcttanaggatgacacgccaagtttaacgacgcagttcctctggaaagatgacntgtgaataacagaccncaagggttgcctctcgacccagcctgttcangantcacaagctctttaatgtcatgtaacnttccatatcatnttngagnggnncctgtgngncacaccctgtgaagngtgtatatgcntcctncagtgctggntgcttaattcttctgcattnaaatgtcctgaccatcttgaaaacatcantgananantcctgtgcatgannggatnctaagggctatntatgatgcntttttaaactcaatgggngtttnncnaa

SEQ ID NO: 4577 - DNA, 726 bp, Homo sapiens
  misc_feature (1)...(726): n = A,T,C or G
gagcccagaatgaacatgcggnccccccaagttatcntgtgatcccagggtttcaagatagacttttgagtttttcacagtctgtcttanctcagcangataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccanaagatggggcagctcanagactggtttcctaatacacaagacctagcnggaaatgatcaagaaaatattaggcatgcanataggaacaactctgatgataatcattnggnttcagaagatactagtgccangctaagttggtgagcatctgggagaaagatctggggagaagatcctncaaagccacctgtagcaaaagtcaaatgtggtttggaccttaaaacccngcattgaacttaagtgcttttccaaggaagttanaagttnccagcanattnggcaggaactttctataccttaggtnaaacccagggtattttntggaagaacnnagtcccccttgnnaagtcttcaattatatccccagtaaccaanggtttnttttngngaaccccantggccccttgatcccgnttcaaantggcttttc

SEQ ID NO: 4578 - DNA, 1071 bp, Homo sapiens
  misc_feature (1)...(1071): n = A,T,C or G
tttttnaaanaattncccaatnntttttggtnaaaatttttccnccnaanttttccaagnaacccttaaccttttgggtttttgccttttttttttgggncnaaggggnnaatcccccccaattcccgggaattttncccggccnttccttgggtttggggggnaaggnaatttgggggggggnaaggggggggggggggcccccttaatgggccnnntttcaaattgggcccttttttnctttgggttaaagnttgggcccaaaaaaacccccccctttaaaaacccccattgggttggcccccaagcccaaccttaaagcctttaaggtngggaaggaatccttaaacaaaggaatccaatccggncccttccggccccttcaattttaaagtcaaaaanggcnttcaaacctttcttggctttccacaaangtcaatctttttttggttcacttcttctggtnaaaataaatcaaactcacgccctcaaagttcttgttgtgggaagtttgagggtgacaaatatttcaacaagaaatttgatgcccatatgggaaaatcccaagctagctttttgtancaagttncaaaaatcaaatatttcaaaacagaatgagaagcttactatcgtggtgggaagtacaaggctttggtgttaaacaatcctgagatggaatttcatctcttcctaaattagaagctgcanaagacctagtcaaagtctgaacccttatgagctttcgtttcctcagctgtaagtggaactaataacactgaatttgatgaagttggttatgaaggattaaattggacaaaatgggaagtgtgtagcatctatggcacatagatgtaaaattaaataaagaatgggacanggtgctattnaaaaatatttaccttggcccggggtggcaatgggcntcatgcctgtaaatcccaaaccagttttggggaanggcccaaaggcngggtgggaatcaacnttgaggggcccaaggnaagttcaaagaaccagctttgggnccacccattgggntggaaaaccttcaaaattccccttttccccttn

SEQ ID NO: 4579 - DNA, 1052 bp, Homo sapiens
  misc_feature (1)...(1052): n = A,T,C or G
tnttcatcagctcttgttttatgcggaccctcgattcgaattcggcacgaggctttatgtatcattaaatttttctcatagttcagaaaaaatgtgccaaagggaaactattggctcctccttcaaaaacagtcttaattaactttcattatttanccggattaaaactanccagaagcagggntcanggggaaaattaaaatggatatnggacccctaaattgtatcattctgagttgattgngtgggttattcattctggaaacatgttgatacttacagtcaaccactgntttttgataagtgatattgattaaggttgaatcttctttgtaaataagtatttacccagttagcaaaagtctgtgttttcaagaattaccagtgagcaccaagagggtgttcattaaaaatgggggaaattgaagtncccacttccggnnaagaaagttggctttaaaaccttggaccacttggtttggaacaatttttgggggccttgggaatnaaaaaacccccctggttggggnggggggggttccttggttggccttgntggccanttttggccaagggnaattggggttgnaaagnccaaancccggttncccccnttcnttcnaattggttggnaaccaaacccccccaaccaaaggttttantttgccccccggggaaatgggttttggcccccaaggaaattgnccccccccctttaaaggggggggnaaccaaagaaaagttccaaaaaccccccccccnaaaccttggaaaggggaacccccaccttgggttncccnttaaccaaggnaaagntccaaggggaaaaaaataatttgggtaangggggaaggaaaaaaaaaaaanttaaacccaacccaacccaaaggggcccttggtgggttaaatgggtttaaaattaggnatgganaaattanttgggaaatantggtattanttnaaatgggtttaaaaaaattggtaccctttgaatcaaaaggtacctttttttattaaaacnttggnccctttttttannggnaaannttttt

SEQ ID NO: 4580 - DNA, 761 bp, Homo sapiens
  misc_feature (1)...(761): n = A,T,C or G
ttaatanatccttgtattggcngatccatcgattcgggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctatcangataacccattcaggtttctttactcgatctagatcatgtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcntaggcttctttcagtctttatgtcacctnaggagacttatttgagangaaccttctgtacttgaagttgatttganatatgtaagaattgatgatgtatttgcaancattaatgtgaataaattgaatttaatggntgaatactttcaggcattcacttaataaagacactggttaaccactgntatgctcaatcatacccnctaaaaggtacaaatggcctttttacctaatnctaattnaaaaattnccngactggnggtaaaaaaaaaa

SEQ ID NO: 4581 - DNA, 780 bp, Homo sapiens
  misc_feature (1)...(780): n = A,T,C or G
nttnnnnantacnatnncangcctntgtactgcgangatcccatcgattcgaattcggcacgaggnaaagccatctttgcattgatcctcatccgcctttttgctcgccgcagccgcctncgncgcgcgccttctncgccgccgcggactccggcagctttatcgccagagtccctgaactctcgctttctttttaatcccctgcatcggatcaccggcgtgccccaccatgtcagacgcagccgtagacaccagctccgaaatcaccaccaangacttaaaggagaanaaggaagttgtggaagaggcagaaaatggaanagacgcccctgctaacgggaatgctaatgaggaaaatggggagcaggacgctgacaatnacgtagacgaagaanaggaaganggtggggangaagangaggaggaanaagaaggtgatggtgaggaagaggatggagatgaagatgatgaagctgagncagctaccggcaagccggcngctgaagatgatgaggatgacgatgtcgataccaataancagacnaccgacnaggatgactagacagcntnnaacgaaaagntaaactaaaaaaaaaagccgcttnacctatncaccctncactgccgtctcanaatctaaaccttggncccctttnaataanaaaaggcccgnccggncaacngtgggccantgccaccccgaagatganacncgcttttcaacacccaacccaaaccttgaggaatttggaacaaggggatggaaaaaagaacccnnnt

SEQ ID NO: 4582 - DNA, 756 bp, Homo sapiens
  misc_feature (1)...(756): n = A,T,C or G
aanaatcctncctcccgtttnnattcntatacaagctacttgttctttttgcaggatcccatcgattcgaattcggcacgaggccttgagggaattanacagattttctgttttgaatagccaacacatgtttgaagtactagctgccatgaatcaccgatctcttatactcctggatgaatgcagtaaggnggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttccctggctncttttaatcagcttctgcaaaaagacatcatcagtgagctgctgacatcagatgacatgaagaatgcttncaagctgcatcttttggatactgtctaaaacttgatgataccttggggnncccctttn

SEQ ID NO: 4583 - DNA, 751 bp, Homo sapiens
  misc_feature (1)...(751): n = A,T,C or G
cttnttacatctctctcgttttattcgataccnctacttgttctttttgcaggatcccatcgattcgaattcggcacgaggagaacctaacaaatgaatgtggtgggtaaggaagagaaagaagtnnagatgaaatttccactctgctggggaaactaggtagatagatgatcatgaagaatctgaggaagagcagaagtcgtacaggtaagaatgaatgcattcattaatttattcagcaaaactgcctgaagaataccatgtgcagcactgcgggacaaaacagggcttgcattcccaggctgtnctcttgtgaggacaacangaaggaagttgagaaacacacaagaacaatgctaagatggggaaactccatacgctgcgggagcacatacagacaaagtccaggtagggctcccggagaaagtgacatttctagtgattcttcaagtatgagatagtcatccacgcaaagagatggtagaaaagtgttttaagcaaaacaacaaaatgtgcataggctcagaggcctatctgattttctatggcangctgggctttcatcggcaganaggatggtcttantgaangaagctttgttggttttgttttcgtttcgtttgtttaaatggtcatacaaagtttttattggctaccttgcttcaagaaaaactgggccaatgatgaggtgatcatttctattaatagtttcattacngtcctgtgtcattggggttaacccaaaaaaatt

SEQ ID NO: 4584 - DNA, 757 bp, Homo sapiens
  misc_feature (1)...(757): n = A,T,C or G
aggancnntnaactcctgccagtanagaanacaagctactngnnctttttgcangatcccatcgattcgaattcggcacgaggtttngccttgtnggccagactagttttgaattcctagcttcaagtgatccacctgcctcgacctnaccatcctagattgtaaaccttgaaattttctagagctgnctcccagtgacnttaacttactgngtggatctgccttgctgccctnacttttcatantctcaccccgncctcaccacttccttgncttcnnntgnactggcttgtgtttacaacatnggattaacagctgnaaggtcagcaatgaattcccaaatangcattcagcacctattttcagcccttcttaatttttctgngacattcgtacctttntaaagntcttttcttggntctgatgacctgagatatcttgattttcctacctcattggnatcctcaactttcttcctctggctttgccatnttgntcctntctcctcgtattcattgggggncccatctgccctctgggaaagttcaacananggtntcnatacctactccgcgnntncaanggcccgcctaatgaatataaatgctccanggcaccaaancacaattcntttacaatgcaatccanncccttctcctgacttttcttggcaattntactaacctaactcntggttggcttcnaaaactggntnaaaatggaanctacctgctaccccaaantggggaaagggccc

SEQ ID NO: 4585 - DNA, 825 bp, Homo sapiens
  misc_feature (1)...(825): n = A,T,C or G
ttatccnntaccnaannaacccttgcaaanccgcgnccngncggagacnctagaggacncccngntaccnanttnaatgggcacnatagggancctttnaccgatgangtgggcgccggtntacacccnatntactgtgantatatngnnttgtnncncggnggcatcacagcattctnntcnactatttcggggccaaantgagacgtggaactgannccctcttactacaacacaacttnnattcacnncatcnangtcnntngccanagnngagggngcatgaaacactnatcnnangattnncnatatganaccacgcggtaangtttctgnngctnngacnnnacaggcnctcnttcaagtgcttncaccagcagtngaagnnnggtgncccgcctnctccgggnnggtgacnantccnncaatnngnacacgggttncctgtnnntacnagancactnacttcatgccagaaccngcatnnangnnntnatgncgactctgtnccttgttcacnatgtactaanggcttnttttacttgtcgnngncncgtgggaacaatagtcttnantntaggggataccnttngtgnaaatancanccnatcccananntgaancntaacntntccgggccttnannccantccgggttaatnagcggaatttgntggnngcactntnnccccncacctagttncaacgagganctacccggggnttanncccaggcctttcccagggctgaattncnaaggggggcttntggtaanncnaagggaggttttccaaaacttcgatnngggggggngnaaccccccn

SEQ ID NO: 4586 - DNA, 1546 bp, Homo sapiens
  misc_feature (1)...(1546): n = A,T,C or G
ttttngggggnaatncanacggnggganaacancccctttttttgggggganaaaanccccccgcnnatntntagcgncagcanctcnacagtanngggtnngagcacatnnatncgagggagngnnnttgantntnncncnctacgnagntacntnagnacagngcacnntnagntttgtgnnnccgnttttttttatgncataagccnnccgcnganatacaatntggcgcagacgnnnaggtgcggcggnnnanagtgnccagnannaggcgcnggggngcancagncgcnagnancgcccanncnccnnctannagnganancgnatcggnncgnnnagaggcantngtcanncgncgcgagnnnnagnnnnnnntnnncgangccgacgaananagnnaggngnccnncnnnnagngnngnagncanaaannnantnncncaaaanaggnagnnagagnntgnnatanntgcgcncnngtgantanccnaagnncnacntccncggnncccgnnnngancaggcnncagaaggngcccnanncntnnataananactncnnnnctnacanaaggnacnnnnncngcacnntgngagaagangccncngnnaggnacacccgganngnnnananaaagnccgggagcanccaacngnantncacntcgnccncgagnatgannngnnncngcnnatntcnccnncnaacagcnntnncngactgaagngtcngnnagccgataatngaacngcnncntactgcnagccgantgnnccccgcgatnncgctanatncgtntnnangcgnntcagngcgcnnnctcgnncgnactnnccatcacgcgcntacantnatnaccgcgangcgcgnangcgccangnnnngcanacacgacancgnngtncacncgcgnnngcgangganccgncncgatnganacgagagctacangagtatagcgacgtcatancgngagnganatgacgantgactntagngcgnacnncnnnngngctncgacncgacactntgagncatcctngannncgnnagcgantcntcgtganacanacgcgcnantncncacgngagannaganggcangcacgcnatcgncgcagctacgancgnngatgagnnntnggangcgacgcncgcntgcagcgcangngacggncntgntgngcgtngtgcncnantangaancncagcgttanancgngatgaagganntatagacagnaccnactggcgacnaagcaaagcangatagactgtgacgcatgacagacggtngagggtnngatcgnncacagcacgcgcggccacanacgtacnnnantagcatcaganncnacagaacncgacagannacagacanacttgcatngngngacgananaatantcncnccacgcacagancagacgagtacgcatgagcgtngngcnngtgannnananatgnagaggcanacnnagntntnnanaancgctgtnannntacncagcgnnngcaganngngcgcncacngnngcnnt

SEQ ID NO: 4587 - DNA, 1003 bp, Homo sapiens
  misc_feature (1)...(1003): n = A,T,C or G
tttttttgaaacctttnnnnntngaataccnanacaaactctgnntgtctnngcgggatcccntcaagtccnatncggcncgagcncanctttntnnanntgtcgcgtctgagcccatgagncacgacnncnttcnccggcgcctgnattgncatntctcccaaatacgtggctnntccncantnngaatnatcgnnatttttagtgccagannattggcnataatgtncnccntgaganaaannctnctgncatgngaaaccatcttnatacttgncgtnncnaaatncattgtganntntgaaggggaacgggcnctnnnaaagngatgaatttcnnataacttnacnggttnatnangaatgattttgcncacanccggaaaatcaccccactnntttgnttcaagantgggcccctaacgggaggggtantagaggcaaaccntctttgcgggctnttntatttcctttnttcaaacaccaatntttgntgaanaataacagtgttttnaattnaattaccaccgcntncantgngattntttgncccattncaaaggntgggtcaattcccctaaaanaattgggaaaanantaatttnccatttcntttttccnttnaaangaaaccntnccntgnanttaaaaaaanattctntntnnttccncaaattttttnnttttnaaaccnctnancggctaaccaggnccgnttttcggtgnccctntttattgttggccanntaaanccccnttttaaaaaaattggccttnaaaaaatccttaccatttttnnnaancctaaaaanggattaaactttcaaanccgtnaantaaatttnngggggttcatntnnctttgaactccccctgcntcccntanaattngaattgncacattggtngnanccaaantatggatntttcaagannaanactgggcttncaaatgncttttttcancnaatnanntnatattgccattttgnggccccccccnt

SEQ ID NO: 4588 - DNA, 997 bp, Homo sapiens
  misc_feature (1)...(997): n = A,T,C or G
taganncctctnctcttgaagcccntcccancnactcgaattcggcacgagcaaaaaaaaggcttttccctgatttccagaatgtactgggtggtgtccatctggtcttgggatggtgtaagcataaggatttattgaatgaaagtatgaaagtgtggtttttatttgaaagtcaaatatttggcagntggtgttcatttattctataaactttcaaaacagatgacaagttttaaggaaatgggggccctaataccaaatttggttgaattaaatgaaattcccaagattcttttctaacctttttcttttttaaaagacaggggtctcacttctggttgccccaggctgggaagtcccaatgggtgccaatccttgggcaagactttgccctgctaagttttcccttaaggctaaatggttaaattaagtggggtttttgtggaaatttcntaagaagccccatttaaagaagggtaagttttttttgggaattaaacctggttttttccattcttacctttaatggaagcctggacctggtaagtttcnattcccacctttaatggaaacctggnaacctggttttttccaatcccctccttttaatggaanccctggaacctgggtaaattggggggaaaaaaaatggggtgggtggtnggtncaaanaaaaaaggtttttaanggnaatttggggaaaagaaaaaattttccgggccttggtggccntttttccccaagggttaaaccttaaaaaaacccaaaaagaaaacctgggttnggnccctttggggtggccccctttggntttngggaaaattcctttttcccaagaaatccantggaatncaagnaagaaaaaaaatnggggtggcntaccaccttccaacaattttttaaaaaaaaatggaccacntggaccnccccctggaccattaaaccttccctttaaaatttancctaatngggggaaaaatttttttccccccttngg

SEQ ID NO: 4589 - DNA, 945 bp, Homo sapiens
  misc_feature (1)...(945): n = A,T,C or G
ttcnatancaaagccttaacctcnggtttttttnttnaaaaggcccccggtaatccccccaattcgggaatttttccggcatancnaccttgcgttganggnganagcnaagtcgggtttnggtngggnaccnntgcatggnntaggcannagnntanggcaaatcattatccgttnnncaanttgggacgncgcncccccnaaaattngggtttaaccactttngngtnggggcccntttccaaaggtggntttcccgaagggccncttttttaanngggaannttnggaaaaccntttttttttngggancaaanacttanaanngcncgggggctttancccccntggtnataggcnttttggaccctncaagatgttcaacgtgantcntgccaaaggtttggnnacttggtgcangggaaanaaattgaaccggccaatgnggatgccttgcactgaagaagnacntcaattgctttggagtctggagaaantgcattattattngctacaaggtaancatnngnatggactgntcatngctgtgnatcgtntntnataatancngagccnaatgaannacacttctantngttgtactgnaataatagggttnangntnntagggcagnttgtgtcncaatcnccntangggatcnnatggtaatgatggtatctgnaancctgncatactgctttaannttnngggggaaaacnggctgagtacttgaagtgtaatgnttcnttacntccagtagcnananactggtatcattcagtttttntcantagnttcnncaaggtaangnanaatgtttttaagnaaaaatnnggcttttttgttnggggggnanaaaantttcnaagnaactcggtgcctacnnaaangtgcattnttttgtggaaaaacaantttttgccccgngaaaaancantttttt

SEQ ID NO: 4590 - DNA, 754 bp, Homo sapiens
  misc_feature (1)...(754): n = A,T,C or G
aatcatctctaccgtttgantgccngatccctcgattcgaattcggcacgagggccaggctggtctcgaacacctgacctcaggtgatccaccctccttggcctcccaaagtgctgggattacaggcatgagccactgtgccctgcctgtaatttttatttaatttttccggtgatggcatgagtgaatgtccacatttaaagttattttggttcacacatggcctttgtttattatttatgagaaaaaattatagaaataatttaagggtggtacagaaatgcaaatctagaggacttaaaatgtacatgaaaactccatttgatatgacaaataatttacaggtcaaatattttaatatttatatatataatagatgccagttagcacaattgacaagttctcttttacagaaaaggccccaaaatgtcttctactgatgccagatcagttgattatctagggatagatatctgaaataagctaggccaatttgattttctcactcaggaattattttattgactaattttattagttcattcagtcagcaagtatttattgaaggcctgttacatgtttggttgctagagatcaatgatggaaaaattcanataaagtttctgcttcaaacaaagaaattaaattggctagacatgggaaaatagntggccttcccaagangggaaggttctatacatttagtgctgntaaggcctataagaactncctctggattttntccccccnttgc

SEQ ID NO: 4591 - DNA, 1389 bp, Homo sapiens
  misc_feature (1)...(1389): n = A,T,C or G
cttnncttgntttnngccatcntcntccgtgtgcgtngccgctgccnttnnatnccnctgtgtncacaannctgttgtgtctttacactgctcnagtgaatcggtnccgtncttggatcgggnggacctccttgggagatcaatncccccgtccttcctacactttgcttctgtgaggaaaagaatnccaacctntccagcccttttaaggttcccttcatgaccttnaaccctaanccccccanaaanaaanaaccaatttnnttcaacccgggaatttttttgaaaaaaaattcnccgggnggtantttngggaaattttgaacccaaaaccngaanngggaattttaattttttntttttgaaaaaaaaaaatgggggttccccatttaggggtttcccaacccccccaattgggttccccccttttttcccttnggggggananaaagggaaagggaacnccnnggnaaaggtttttggggaanggncccaancccagggganaangggggggggttnccctctangggnnatttccttgggnccaaaaaacccccccccattggtncccttttggggnaaaaaaaaaggggtaaagggngggcccaaacnaangggggtttggccnttntntattnccnttcccaaaanggtttttaaaaaccttttttccaanaaancccccttttcccggggccccntttcttttttaaaaggggntttttccnaaaaaaatttggaatttttttgnttttccccttgggtccccttggggggttcccccctttannccccggcaccnttttgggcccnttngggggggnaaccctttaaccaaggcccaaaggnccccntttcntttnttttaacccaannggggggntttncccctttaaaanccntttnaaaaaccccctttggaanttnggngnnaaaaaaanaaccccccnttnnttncctttaanccccccccntttaaanccagggtcccntnccnttaaccttttngggnncctttancctngggnttaaaccctttttcgggaattccaaattggggnaaaaaggtgnggggggggcccntttggcccccaactttttgggaattanggnaaaacanttttttcgtaaaagnaaggcccaactttgccttaaattttttttttggaaaaaaaaagggaagggntttttgggaaaattaaattgggnttaaaaaanaaataacnaantttgggcaaancnngggggancnttttttnaaaagtttncnttttccccnttttncccccanttccgnaaangggaaagaagnaaatttnccgggtnntttatttccccannccccccntttttttnnggggggnaaaaaaaaatnttttttccntt

SEQ ID NO: 4592 - DNA, 955 bp, Homo sapiens
  misc_feature (1)...(955): n = A,T,C or G
actttgatattattaaaanccctttnccccgatttttctaaatggnccacgggaatncccccnattccggaatttncggggtgggaaccctnggcccnagccnttacccnangttgggtttttccccggaaaaaaaatgggaagggggnttgtntgtaatggtgtntcccccaatttttggccaaagaaagcccaagggggaacaaagccaaggttccaattccccccccaattaaagcccccccttccttggaaaaggggaaagggggggaangggggnaatttgccttttaaaaaaaagccaangggcccaagtttttcttggttccaaagttttctttgaaccgttggggccaaaggtggcccaanttggcaaaacttttggttgcccgggaanggaagtctttaaaggaaagtgcctggtcantaaattcaataangggtccaagaaccaaacaatcttggaatgaaatgaacccacctggaaatgtgttgtggctgacccacaaggaaggtgaatcctcttgcttggggtgcttatggtgtcaggttgcttncttccacatctctcatttgcttaaagcagctacaaaaggatccaaagactcatgagactaaaaatcattctgaggacaaagagacaaagatctgnctgtggtcacactgtgaggcttgcttacactgatgttctctatgggaggtcactgaagacattcagccccacacgagaagatcagagcaacttggaaaccccaaagggagacacaccctttaacacttgccgtgctgtgcttgtgccctgtccttnaaggaaggaaaagaccctatctcctctgggttttgntggcttgacanttgcaacttgatcatgcctttgactncntcatcttnttaacaagaaggaaagaacttgttttttattcnaaacccttttnaatttnnggggggggttccc

SEQ ID NO: 4593 - DNA, 780 bp, Homo sapiens
  misc_feature (1)...(780): n = A,T,C or G
nnaaaaccccttngnngnnacnncttttgaatnccctttgcnactngctctttntgcnnggatcccatcgattcgctaacaagcgattntaaaccacctatgagtatctcttntagggctttcttaantacatgttngnatatactgtatnntagccanantaattttnnatctgatcaggtagtngctaaaattagaaaaaaacaaantagatgcttaaagaatttgcatccatttttgagtctaaatcttttaaaatatactgagatccacatctagtgaaatgtcagtgtcaaaatattatagattatagctaaaatccagattaatactcattnggggttttttatagtggaacttcatagtnatacaaaangcagatngtcttcctgtctccgctgctnccacagtaggtattgaaactggtnaaatcagntcttngatagtgtgtgtatataagaaaanatagatacncacattcttttttctcagtcaacacattgattgaacactctggcaaagatgctgnggtggatgaggttggagttcnaaagaagaagcanagcgctggcctgccttgaaagaaccgaagtctttcncattcacttctntagaaagctgccaagacagangcagaaagaaatggatgataggtctgctaagcacacttctggntctcttagaacttagaagtgnttctaagagaacanaagnctaacgagaaacagttcntngtngaatcaacaatctttnggntggaaccccnttggcntttttttt

SEQ ID NO: 4594 - DNA, 902 bp, Homo sapiens
  misc_feature (1)...(902): n = A,T,C or G
cttttttccaaaaacccccttaccttggtttttttttaaatggtcccggnantnccnccattgcgcnatttnccgnaaaatttncgggnccaccggaaggaaaattagcccatgggaagcccggtnccaggaaaaaaccagggnccaggnaatttccaaaaaatccctggtttantccccaaagnaatggcccaaggtngggtttaatggtnacctccntaaagcccttccaagtttttccantccaatccttgggaataataacaatattggggtaccttaatccttaacaangggggntggtggaataacctataaccttaattaatggtattntgaggggcattagcnaaagcatttnggcacatactagtgcccaanggtgtnctcatttgctgtgctacatggntacccctttctntccctganaaatctcaggatttgggcacactgcactactcatntaacntaaaataaacanaggccgnccngtggctcactctgtatccacacttgggatgtgacgcgcgatcacaaggnangagatcnagacatctactatctgnganaccngtcttctaaaaatcaaaaantaccggccggtggcggcacctgtntnncactctntggagactgaggcangagaatggngtgacnccnnaggcggacttgcagtgagccgagataagtgctactgcagtncgggnctgggtgaangagcaaagactncgncttcanaanttaaantnagtcanancccaaaattaagcaaggttggacccccanttanttaaaaaaanttcccgggttnaaaatttgggaaagccttttnccaagttcnttnttaaatccccaatttantttaaagcccccccttngggggttttaaaaaanncccaaag

SEQ ID NO: 4595 - DNA, 891 bp, Homo sapiens
  misc_feature (1)...(891): n = A,T,C or G
ccnntttttnttgnattttttcccannttcccccntttaccttngggtttttcttttttttnggccaaggggtaatnccccccnattccggaattttnccggcaaattttcggtngccaaccggaaagcgaanttncttagacgtggggaaaaaagnccctttgncntacccccccnanntanagnggggtnggggnccaaaccaaagtcaangggggtaccnactttgnnnaacctngcctgggaatngaaacccgggtttcntnggttttccnattccccccattttcccgntntttnatttttnaatcggaaaatttgntaaaaacncggcggtggtatttaccngnccctttttttcantcggattttnnaaaaaaanaagaggagtggcaaaggaaacccctttctacacataactgaangccaccagtgattcagtnccagagaggaggggcntnncatanttatattcatcnatgcagcaggattttcgngtaaaaaaatcgttatcaggctacacacatggaggaggctgnnntcgcatggtgaaataccacactngatatccactgnatcttgacctactcggccgacnngcatnaggtatanntgtcnctntntttttctttcctttgatntttncngtgtcgnttagaacaaagctcaatctntcatntangntcantgcntngtcncaatttnagtttaacttgttgccntgatcttnccaggnttaagcnaatttttgggcctttagccctcncaaattacnctttggactacacggcntttaacccagccttgccctgggcntgaattcctgngatccttttnggtaanaaaaatggggggtttccaaccatttttgggtttttttttngggggggg

SEQ ID NO: 4596 - DNA, 828 bp, Homo sapiens
  misc_feature (1)...(828): n = A,T,C or G
cannnncgtcgannannnannccnaannaaanannnatnaangnncnnnanannnncacnnnntcatngtnaccttgaanccttcaactcttgcgtctcgangnnccaagnancgnannggaacgagccaanntttnacgggcnancntgcancccacccaagacannnatnggcaanngggcaanncaacggagtncannnaactnaaacnggntgccanagataccggcntntgccanagaantnngctgngcaattgatganaaantatgagnagcccncctcgatcggganggcnacangggccgnaannggnctnacnctgngcagngcatnatgagcggcaaaangngnagcttgaanncannatananngatactcnagcnggangccgggagtgaannacncnanngctatataacctaacnttnaacnagatgggncaacaatgccnanaacagggncacnntangaaangttggggacgcccccatccgggaccangacacatgagntactncntcaangacanagatcaacacangggngaanacancacacactgcnntaacngaagcatgaanggaaatgtggcctttcacnaaaagcgnacaanggattgctagattgaanacaaccttaaccctnctntagcacttggcgattnnnntntacgggaaanggnncgcaaangaggctnctnntgngaaaaaaaggnccnntctcagggaaactttttccccgngnaacccccagcattgtggnccgggcaccccnagggttanttcctacaaaagtnccgnnggcccccccccccccnccnnct

SEQ ID NO: 4597 - DNA, 1395 bp, Homo sapiens
  misc_feature (1)...(1395): n = A,T,C or G
acccccaaccnncgccccnncccccaagcnnnacgccncggcgcnanngcgnnnacggggcacgcggcngcctntgaacgcttggaacnccncctcgacgcgcgggccngcacnaanngnccgngcngnccccgncgcnggnnnnnnangcctttncnncccnnnacnnnncacnccngaaagcccnncccnccgcnaccgagnaccnncnccnnccncnnccganccncncgcgcncngggncggnantnncngnggccnanacnnaccgncnnncncgnncaccncngaccaaggcnnncnccacnagaccnnagnnnnncncnnaccccncannccnnncnncatacngccncnatgcnacccaccnccccanccancagncnnngacctcccnaacgccccnctcaacgncnancnncacgcgacnacngccgcnnanncgctcnannccngccanccacnnaccancgcnncagccgcncgncagcccggnccacnncnagcacnacnggctngcaccannnnncacctnnncgnacnccaacngcnnctncnngcnctnnnccangcnncacgnacgacccannncnccagagcgnnacccanncagcacgncngnannatcncgccccgcncnngcgcnctananacgcgcgcaananaggcnncnccnnncacaancngcngannangtnnagcnnnngnctgnacnanacacacnnnaccacnnccnccatgnncanacangcngcnnntctnatcnnnnnngccatntnncannaancntncacccccnagngnagnncaaanatgnngcancnccntcccgngntanancncggacnacncagncancatacngancgncnccanggagncnccntccganccncgaangncncncannnccgnccanncnntnncacaacgnacacgacnangnncgcagcaccncggcggccangcnngacggccanancnancagcgcaccacnanaccacaggngnncnnncaacgnncacaacnnngcanaaccannnacccctangacannacgggncancggngncgancnnnccngcancgctacgancancgcgnantgcgcccacgacganacacgnacannnnannnngngngctccngacanncnccgcccacacnctncgcncccccncncccagcagntcgnntcnccaccgcagacgcncanagctacctcnnncngnntnnncccnnnccgcacanccctannnctacnangnacgnntcgcnnaacantcgcancnccancctncncnnaccacnatgngatntccgcgantgcacanncnnnngngccncntngcanntagacaccangcaganncngtncnnancgcngccnccg

SEQ ID NO: 4598 - DNA, 1053 bp, Homo sapiens
  misc_feature (1)...(1053): n = A,T,C or G
gtgncctcccntccttttcaannnnntnggaantctcnctcgctntntcgtgcnnncgccnntgtgatngcangantactgagatgggatncnncccacgtngcccnttnctggtctcctgagctcaaancnggncagattgttnggattacagntgtgancctcccntccnngctgnanatggacttnttaaaaaagnnctctnttaaagtannaagganggntgnanttgantncccannangacnaaaacngggntgaaaaaccatcntaaaaggctgnnatnnnatggnagctanntnngntccncngnnaccttcngnccccnggnanctnntgnnttctnnatcctccannnctntcanntagcncngnnattttnancattnttccaccnntcgctngcntaatttcnnnnnttatgatttttnntcaccgnngtctctttcnnntcnctntnntgccngnctctcctnnncnnnnnngtnccctantntgtntaccncancatctngttctacnntcaacatttgnntntngnnattaacattncngtctgntcancttcgntncttcanntnntannctnttgnnncgnantcngttanttcttactctcncgngnctannttgtntgatnnttatcgatntcacctcnatacacntatnaagancnctcncgnaatactanctnctnanatanctgatcacgcnngncctnntgnttntaatactcaacgtcaccnttatngcgcnataanttcnnancttattgacagnacattatnatnannnatannttatactngantnatctagctcgcctcacanntanancacnntncgancgtnttnnnctnntnnatnatctntcnntcnntattatctcnatcccgnctatatnnattntttnngnnancttcatacnctcnanactctcatnacnnctnctcncttcnaatgcntncnngcttntgatntngctcanaatcaccatctnattatctcatntccgttctcctnntacnatntntatntcnttagncctgnncc

SEQ ID NO: 4599 - DNA, 1053 bp, Homo sapiens; identical to SEQ ID NO: 4598
  misc_feature (1)...(1053): n = A,T,C or G

SEQ ID NO: 4600 - DNA, 1020 bp, Homo sapiens
  misc_feature (1)...(1020): n = A,T,C or G
tntaatccttcttnctattnnttnggaatcnnantngctctatngcgcttgggccnatggatgccgganaactnnnatgggatttttccnacgttgccnattctggncncctgagctcaaagcaangcnggattgctnggattacagctgtgagccancgngcctggctganatgacttttanaaaaagactnctntaaagtagaangaanggtggaattgtatgcacaanaagaaaaaaacctgnaagaaaaacatactaaagaggctggantgcaatggcncgatcttggcncaccgaaacctcngtctccngggctnaagtgattntcctgccnnagnctcccaggtangctgggattcaacnnatgnnccaccannccnggntnattntgaatngntantntcngacctgttcctctccatagantggntcncggaanntctnccatnttcnntganctacangnnntnncnannctantanntnnntcnctctantnnngntactntnnanntnatcatnttnaantggntctctatctcnanttcactaatngncctngnacnatnattancgnnaccnnctataaaatacacatncntgnttcnnntnanatacaatnacatccntngtgagncactnactnanacngtgatctctcgcantntntcnatcnnnccnccatatnnccanggcacatctatntcagatnnaactcanctngtantattnaganacnctcgacncactntctgttatacttntnncantctntaatagagntnttncganncnnncttctgntnnncnanacnacattntnntgttacatcntnnatatngcctctnattntancntcgtannncattntncnnttctncnctcattancnntnntancantcntcncncnntatntaaanncgtncacacagtgcnnnntatncaccgaanntacntnnacnttatcacataatcnctgagtnnatatactcnngttnntctattcnctatccc

SEQ ID NO: 4601 - DNA, 1081 bp, Homo sapiens
  misc_feature (1)...(1081): n = A,T,C or G
ttnaaccttcaccaccggtcangatccctcgattcgcagaacccaagagcaaaagcagccttcactnactgtcccatgaancaaaaattggatcttttctaagcaacagaaactttaggatggcnangacaaaagctnngncttnntccntntganntannatatgnaatggagattctttctnatgnngatcccattcngttagccntaaaaannncatacgngcnnnncggaatnggaccttagcaaaccaaatgcggnaaagcctgatggncgaattngaangangccactgnccccttaaaaaattgagcctcnnccttnccctgggcgggnaaacccccttccttnttnaaccgcttcttnntagntcaaaaagngnggtaaatnncccgggtttcttatagnatcttgntaacctntatcctttgtttgaacaacttttcatcccctnttntntccccgggnaaaagncttcttaaaaatggnngggnccttttcnttttantggatttttccaatnnttaaacngcttttaatcggnttccctaaggananccccggaaaaaaaaaatttgantttngggggaagnaagnatttccaacggnaaagaanccntttcccttgggnggccaaaatatttnatggacncttttttattttcccccccttttgttaaaaggnctttnggaantggacccccttctnccacctttaaaaanacctnggggctnggtcntttgcccaaaccataanaagttgggaatagctatggcccgggtnntttaaancccttgnggaaaaaaaangggtttngccntttnttttncncnccgtaatttnnaaagggggggggtttttttttctncntttttaaaccaaanggggncccaatttnggggaacctgggaaacccngggtttcccccattttttttttttttttttttttaancaattaaanaaaattcccacantttntttttttggngnaaaanggttnnttgggaacccccccttttattanggnggngggcccctttgggnaaaaanattnttttntttnngggcgnaaaaaaaa

SEQ ID NO: 4602 - DNA, 1046 bp, Homo sapiens
  misc_feature (1)...(1046): n = A,T,C or G
cgtntttaaacncttnnactcccgtgcttnatgccganccacncgtacttaactggcgcgngatgtgtgctttngtnaggcatcactttncccaagnatttcatgttcatngtaaagaggaaaaatacanattnctctataatgtctccactnattggctaantcgccacttntcatctntgtgggaaatgccangttttgaantcaagccttcnnnaattnngaacatttnttncaangtttattccccaattgcgggnggaanatccctnacctggctnaaaaatnaaatttctttaacccattnggaaattngcntaaggnnccaaaanaatttttggcnctggcctntcttttaanggncccttttncccaaaaaanggaaatttggcccaaatttcttggngggacccctggnccaacncctttccccttggaaaccnaagncccccggggacccattggcctttnaaanaaaatgggnanttnggncccnanaaaaaaacnccccctngggggnaaaaantttaaaanngggntnggccccntttaaaaccaaagnggttggnaaaaantaaggnncccttaccntaattttnaacagnttancccttttttggtcctgggaaccaaattggnggnatnaaaggcggaaaataaatttgggaatncccccaccccaattntngggaanagtnatttggncntttttnaaacaatngggaaaaaatctttaaggtccnaatnacccctgggggccttggaaagtttnttcaaaaanggatttnccaaaaccctaacccttcccccaaaaaaaaaggggattccaangggtttanttnccctcaaatncaggtancctgncccttaaattattattaaaagccaccctttcccggaagaatccaaatnccgnaaccanagtttaaaaaaanccaanngaagccttgggncanggccagttttanaagaaaatggcccnaacaacccccggttttgnaaaaaagaggaccnggggttttttttttttttnaaaaaaaaaangg

SEQ ID NO: 4603 - DNA, 891 bp, Homo sapiens
  misc_feature (1)...(891): n = A,T,C or G
ttcatcctntntngcttttgtgcagatncctcgattcgtgagtgtgtaactcctaaattagaacactttggtatctctgaatatactatgtgtttaaatgaagattacacaatgggacttaaaaatgcgagggaataataaaagtgaggaggcccttagatacagaatccaggctcaatggataaatgtttttggcccctcccacccccatcatccagnagttgggaaaaaaagtgatgccgaatatacccaactcttccttttggtaccctaccatttctggtacctcctgggttttggaaaaattcccatcntaccaaaggaaacaggcattagccttttgggtattnccccaaaanttacccccanttanttcaaaaaaaccaaaaataggtttcaattcaaaaatgggaattttgggnaaagtttggaaagaatccggtacctttcggtttggggntttttaaaaattccaagaaccaccattgccttttggaggaaatttttaaaccaggaattcccctttnttttcaacccttaccggaattttcntttctttaatggaagnaaattctggcntcaagaaacaacccttaccacccnttccaagaaaggttaaccttnaaaantttcccagaaaagaatanttcntnccagcntttttntcaaaaaataccaacctccaaaccttagcttncttccaatagccaatttaaagccgtgccnccccagtnaaaaggntccttaaacatggacagaacatncgagatgtcagcaacaaagaaactgaaattccgtggatctatncacacagaactggaaaaaaaaaaaaaaaactcggcctctanactatagggggtccgattacgtaaattcccccccagggnaaan

SEQ ID NO: 4604 - DNA, 877 bp, Homo sapiens
  misc_feature (1)...(877): n = A,T,C or G
tcgnttngactnttgaatttngaagccntgcgngaaccctcangacncanncgnnncgagnggnantgnncccnatnctnagatttttctgggngnantgcatgnggtctnnnaaggcggntnctngaagaaccctngnttgaattacnanagagngccnngnattnnaagcccaatatntggcnngcggtgtccattaattntatanccnngcnanacagatgacactgttttaaggaaatggngccnaacccaanccgggtggaangaatgaatnncaagantnggtctancgggganttttttaaagacanggtctnactctgttgcccatgctggagaccaatggngcaatcttggcaganttggctgatagttatccttnggctnccgnaantnncggnnaccgngaaccccatagccgttaagaaggtnaggcctntggaatgaaaccgtttnccancaaacnaaaagagctgactgnnaaacncatcccactaantggaaccnnnnccggcttntnaanncntcnntnattnancctggacctggccctagggggaaanaaaaagntgccngttggcnaaanggaggntnccttttntttgnnnaaacaaaggattnccggnttgaannccttgtcccncagatgtntcntaaaggacccccataaaaccngggnncgnnccaaggggaggnccccgttgggatnttnggaggattccttttccccaataaaaactnttacccagnttggnngagcnnggcngccaacccctccccgnttnantcnttnaaancnctctctngaacncccctcnnnatntgctcccatttnaangnncctaatggggtttttttttttntnnannnccct

SEQ ID NO: 4605 - DNA, 854 bp, Homo sapiens
  misc_feature (1)...(854): n = A,T,C or G
nnatcantttatcangctttntnntcnntttgcaggatcccatcgattcgcatctggcncgaggngccataanctcantttnaaanngaattnnttttaantgganganatnctntcgntnganttcnggctttntganggngacggntagnnantcnanacacacttnctnnacattaatggganncgngcctganctcggganctnccaaaangttngnntttcctacgaatgancacnccntggnctgngnggaatncgggcganttagngctgcnatggtgacattattnntnctatataacantattgctggcntncctaccgnagnnnntnnaccctgnantgtggcactnccctncatatccananntcctccgactgtatatgccttccgtgcngcatacaannnangcctatancttaanngnaaccanannnntgnggaanggatgantccaatacatgtgnncattnntncatgngtgttccnacatgtggncttcgaanctcangctttggaaaccagngtttcacgngacaatganacctttccatgcttntntgccccncaatntncctcaatttnnttataancaaaaaatttttnntntattttcanaaggnggtccagtanttttnttnacatggganngactttaaaattncctaagcaaggggaanccatcttttaangancattaantttctntgggggganaatccaaaccanancttngaaccttttttcaatgaacttntngcaacnttattttttgagcanccaatttttttcgtttgaaattcccaaanacaaattgtgttttagaggnnnnaaaaaatcncttccnct

SEQ ID NO: 4606 - DNA, 1401 bp, Homo sapiens
  misc_feature (1)...(1401): n = A,T,C or G
ccttttgaaatttttnnaaaatttccntttaccncgggtttttttttnaatgggccncgggaatccccccnatncgggaattttccgncntncccttcttgggaanaggaaaaaatnaaatntnngagtttantggcccacnataaggggaatccaaagttngccaaangtttanatggcctgggtntngttgcntcccaactggaacctgggggtttcccaaggggggaaccccccgggaagaaccctancccaaacttgaattttaanaagaatggaagaaagngggggtttanctggggtcaagaatggaaacaaatncctttccactnaatgggcggtggaaatgggcccttttaaccanggaagaatgcctttggcaggcaanggaaggaattggccaagaatggtcccttggcttccacaagtantccattgggcaggncaaaatggaacnatggtcggaatgaaataatggtttncccccnaaaaatcattanntagtngaacnttttttgggttnggaaanccttccttggggccnntaaattaaaagaaaaaaatggnaaagaatgaatggtaacaagaattanttgttcaaaccngggaccttncttcaaagccaagtaantttaagtnggaaagttcctcggaatttggaaaaaaaanccntttaaaaaaggnaaccaaattttttcccaggnaaaaatttgggaaaatnaccttggtnaagnaaaantttccttggattttcnttttttaaaacaaagttaaggcccaaggggggnaaaaaantgggtttnnaaaaccttanccaagggggttgggaacccaaaaaaaaaaaaaaattanccccccccaaggggnttgnaaaaaacccaacctttggggccttttttttgggggttaaanggaaaaaatttngggngggncccaagggttcccanntttttnaaaaaaaaaagggtccnaaaaaaaaaanttttttttttttttngggaaaccntttttttttntttttttttttttnaaaaaaagggccccccaaaaaanggggnanccccaatttaagcttttttttttnaaaggtttttttttaaaaaaggncccccaccntttaaaaggggttaaagcnaaattantttttttaagggggggggggaaaaaattaagggtttcnaaaaaaaaantttttttaacctttgggttttggaaaaaaaaaaaaacccaaggctttgggcctttanttggttgggcccttttttntttttaaccccccttgggttttccttgggttttccccaaaattttttttggccttgggggaatttttnggggaaaccaanttaaagnnccccantttttcccnttttttttgggggggggaaaaaaaaaaannan

SEQ ID NO: 4607 - DNA, 788 bp, Homo sapiens
  misc_feature (1)...(788): n = A,T,C or G
ngnnnnnntttcnaaancccttttcnaatnccttggctatttgatctccttgcangatcccatcgattcgaattcggcacgagaccctctctggccacatggaggcagtttcctcagttctgtggtcagatgctgaagaaatctgcagtgcatcttgggaccatacaattagagtgtgggatgttgagtctggcagtcttaagtcaactttgacaggaaatnaagtgtntaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctcagatattcacctaccactttccatgttggggcatgaaagtgaacaataatttgctatagagattatttctgtaaaatgaaattggtagagaaccatgaaattacatagatgcanatgcngaaagccagccntttgaagttatataatgttttcncccttataacagcttaacgtattactttttcttatttggnttatnataananagntgngttantaaaan

SEQ ID NO: 4608 - DNA, 793 bp, Homo sapiens
  misc_feature (1)...(793): n = A,T,C or G
tgntcncctagggaaaccctanngaaaagcccnccanntttggnnaaaactncgctncanntgacgtccacacaccctnctcgggtagagntcattttgtggcaacggaatgcnccggncaaacagnagngnatnttnnnggcacagaaggccngngccantttcatggacacctggctggacctcngnggaagngaactncgataagatgngtgcgttcactgcagnacctcacantgataccgtccnctctaatggaacngancctccccacatgcacncnccactcaaanggagnttnaaaggctgggttcaggttacaggggcgtnttcttcaccgtctgaatgcnggaagacagantacnagctccagaggagcgngggcgggagacggagctganatgcgngatgtctaggaaancgtcctcgnattcctnagcgcgggcngcnngactgntcgcggcccttgcctgncttncangagcgcttcaacttnnnccaacacacccncggnctgatgttccctnnctccggcggcctgcacaccccaacnatgcctgactngganggctcnccntnccacacngaccntganttngggnncaagtnacancctgtnccaaantaccgnttaatnccaaaagngnacccntgaaaaggaancggnccgggncctntagccngngntnnancngganccgggnnnncnnngngnangntngaaagggttcncccgancgnnttntcgncncctcgnatnnatgcntccccnggcantagncnacntcanncg

SEQ ID NO: 4609 - DNA, 1104 bp, Homo sapiens
  misc_feature (1)...(1104): n = A,T,C or G
nncnaaaacnctttnnnctcccgttctttttgcaggatcccatcgattcgaattcggcacgaggaaaagggacagcgtggataaaaaggttttttaaaaacatgggatggttaaaggctggtttttgctttgggaagaaagaacttnggggaactgggggancaggtcttttaagaatatttaatttggaaaaatgcctgggccacctggtcctaatcctgggaatccccaaggggctttggaanctaagggaattttgaagggaaagttcaccaaggggaaagccaagaatttccaagtcctggaccaattttatttccantgccaaaggtttttttttgggtgcctggtaagttattattgaatggaaaaagaatggtaaaaagccttgaaattaaaaggccatttaattttcctgccccctaagaagtttggtttccaccagccccctaaattccaagggccattaatgggaataatggttaaaaaccaaatggaacctggtaaacccgtnggtttattacgaatggttnaaagganccaaaaaattttaaaaaaaaangggggggntttttttaaanaaaaaaanngaagggccattaaaagggaanccccctccaaattggccaanangaattttggaaggggacccanttnaattttttttaatttnttggaagcccttttaaaaaaaagaatggaaattaaggggtggtttccttccaanggaaagggtaagggggaatccttgggccttggaaaaanggggaaaattaaattcctggaggccaaaaaggggtaattgaaaaaccaagccccttaatngccnntttaagnaagnaaaaaaaaagggttcccttttttaaattnaaaggggcaatttttnggggggntttngggggggggaaaaancccttttggnaaaaaaaaaagggaaaaaattnggggggnaaancccttnggggtncccacccaacccaaggggggncccccttttgggngggttgggccccccnaaaaacccttaaaaagggggggggtttttnggggaaaaaaaaaaatnaaanaaatttngggnaaaggggccccaaaaaaaaaaaaaat

SEQ ID NO: 4610 - DNA, 785 bp, Homo sapiens
  misc_feature (1)...(785): n = A,T,C or G
ggnctttgaaacccttgtttacntgccctttntgcaggatcccatcgattcgantncggnncnagctanacctcntatgagggtnncntncagggctacngtgattacatgnatgtntatnctggnnngtagccgctantganttgatatctgncaggttnactcctagatgtcngnaaccgcgtganatctgccgcccgacctnagcatgnatntgagcgtctatcacanctnnnnganactgggatncacatntatgganttgnncnngacaanatgatatanntgntntcntntantcngantaantctaatttnnngntatgtntannggancntcatacctgtacaagacgcncatagcntgantgnctangctgctnaccacatgtaggnattgaaannggttannttagaccatgnacannntgtgcctatacttaaaagatctnttgactanatgctgctccttgtagtacnnnacccctgatctggncaccnctggtnanttantgctgttngccnnatnaggtacggtagtttnganangancatanctggcgctacgncnggccnttanntganccnccatanacatcnnctattattgataccngcccttaggatnaggcngtgtcaaatggatgancnaccantaggcnanttntggtntcgtacnacttggnaacgcccttagagtaatnaaangggaagntgaaacnggggcntngggaaattanacatcgttggcntgangcntaggcttnctnatntttgganngann

SEQ ID NO: 4611 - DNA, 818 bp, Homo sapiens
  misc_feature (1)...(818): n = A,T,C or G
gatnttnttttcaaancgctaggctactcgttctttttgcaggatcccatcgattcgaattcggcacgaggaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttaganacagtgccaagaatgacaaagatntttaaaaaaanagaaagaaangnaaaaanaaaancccctnacttttaaaagnaaaattncctnacnaggattttttaantatnagntnattcttttacccanttttcnttttnctannttccctnngatnttttccaanctnaanggctgggnatttttaaacttcantancttgttgaaagaccaaaaggtggttttttgganttnagnaaattttttggaaaatctggcntaatncttaaatttggtaaaaaatttnnggaaaattccttaaanaaataaatntncttattaaaanaaaaantngngccttttagaactttngngngcntttncn

SEQ ID NO: 4612 - DNA, 817 bp, Homo sapiens
  misc_feature (1)...(817): n = A,T,C or G
ttcaaatngcttggntctngntctttctgnangatcccatcgattcgaattgtgactnatncnaggataaatgtnatatgcgtatgattntgatatgactttgatgagnntcttcagggaaaattnctnaaantgaaattgctggattaangggtaaatgcatgnatagtnttgntagacaggnccanncnnctnccttanaggtngtncccttttgtgttcctgccannnatatntgagagtncacngantatgtggtnnanctntataatgcttgtccatctgatanggaanaaatcgagtatgccttaatntgcccttcttttattatgaatcagattttaatnttttgcctctagaactatagntgagtngtatnacgtagatccagacatgataagatacattgatgagnntggacaaaccacnnctagaatgcaccgaaaaaaatgctcnatttgtgaaatntgtgatgntattgcttnatttgtgaccattataagctgcnatntncaagtgnacaacaacaattgcattcattcnatggnntcaggttcngggggactgtgtgnggatggttttntaattcgacggncacctgtgccaaatgcattggngccccngggaccccagctttntggatnccttttacatggaggggttnaatttggcccnccttgggcngttaatcacttnggnccataagccnggtttnactggtngttgaaaatcggntanttnccgtttcaccaaatttccccacngggnattttctagccgnggnagccttcaaaatggnnanagcccttggggggnc

SEQ ID NO: 4613 - DNA, 770 bp, Homo sapiens
  misc_feature (1)...(770): n = A,T,C or G
gtttnnnnnnnttnnnnnnttcnaatngcttggntactngttctttntgcaggatcccatcgattcgctcaggcttggggggaagaacaagctacttgggagttaatggatgatagctgctgtggccatttttcttaagagttagactggggagatgggtttggaaagtaaaatgcaaatggtgggtagtggtattaggtggtgatgcccaaggcgtgctgtagaaacctgcagggtgaagcccataacttttgttacgggaatggggtaactgaatcctaaactagctaggggagatagggatggaaagagcagatgtggaggttggggagaagggagtgacaggagatatatccagttccagagggaatagggagagctgtgtggctaagatttaactgtttggacatttaatttggggaaattgttttccagccaagtgaataaataatactggacttcaagtncaagcttcatacaggaagtgaagttttggtgtggagatagctgcatagtcagggaacactctaaattaaaaatagggaggccgggcatggtggctcatgcctgtaatcccagcactttgggaggccgggcagatcatgggatcaggagttcnaagagcacccttgaccagcatatttgaaaccccatctnacttgaaatncnaaaagattacccggcgtggtggtgcacgcctgtatnccacttctcnggagctgngcangaaaattgcttggccccggaggcgtggtgcattaacccagttc

SEQ ID NO: 4614 - DNA, 1253 bp, Homo sapiens
  misc_feature (1)...(1253): n = A,T,C or G
ccccnagttttcnaaaaanccccncagttttggaaaangcccctttgtnctanacagggccatcccccaatcgcatttccgnaaaaagngcgncgcagnanggacttgggnnncgcctggacnccngnatannntcgggcaacacactgtcgnggagagtttttntnncagggccgggtttaattacagcctcangggtacggaggggaaaaacnangggggaanattggnanannccgccaaangggattttgggggnaaagnaattaancccaccanangntntactcngncnnaccggggccaaatgcnaggaaatggggaaanacctttccgtnggggcaagcccgggnaaccatngagcgngggaccanttatggggcggggacgnaaacctacnggnccaaacaanggccacctgcttanggaaactagggancgnttaanaagancgcgananaagcccgttcncnnaacctttgnttgnnnnannaatgggccntgggggncntncaacacgggnggnntaaannngnannanngnntttaaacaanncccctcaangggttaacccgnaaccaacctntgncacngggnctannnccnnnaaaaanancccacacagcgatacnncggggagaaaaaatttntaaannnttnnaananccaatngccatnnaaaacncnttgcccaaacngggaaaaaanngcccccggaaatntancaaccccangtagccccanaattnccccaacggagngggccccaantatctgntagggnaatngnggnattnggcnnttnnaaanggnaanatacnaccgntttgngnggcnncaanatgggggngaattgcaaaagngnantttggncaaaaaancnaaaaaancgnccctnttttnnacnancanggggaaanncctcnagggcaaccnataccnancctggnataagaaagtccctnggnnacctnanaagnggngntccccccganaaaaaaaacnaaggnggttancgcaannccaattcccccggnggatattggaaaaaaaccnggggaanaaaaaaaaaaangggaagngcttntccangggggggnaancaattggntnaaaaaaccctttcncctttanangaaaaccnttcntcaaaaaancttntaaanaaaaanccaatnnttatnncccgcgaannccaaagnggtnntcaaaatacngggancattaaaccgcgnnattatcccntnaaaaa

SEQ ID NO: 4615 - DNA, 757 bp, Homo sapiens
  misc_feature (1)...(757): n = A,T,C or G
ttcaaacnctnggctcttgttctttttgcaggatccctcgattcgaattcggcacgaggcgcaatgcgagcggctggcgtagggttggtggactgtcactgccacctctccgccccggactttgaccgcgatttggatgatgtgttggagaaagccaagaagccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttcttccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctganaaagtactgctgcatgcatttgatggtcggncatctgtaaccatggaaggagtaaganctgggtacttcttcttaattnccccttctatcataagaaagtggacagcagaaacttntgaacaattgcctttaacttctatatgcttagaaacagattcacctgcnctaggaccngaaaaacaaggtaccgnatganccnt

SEQ ID NO: 4616 - DNA, 1351 bp, Homo sapiens
  misc_feature (1)...(1351): n = A,T,C or G
ccntttttttngcnaaaaaaaattcnnccntttttngggtttttaaaaaanancccccccatttttttcatnnntttttttnggnncagtnaaaaaannnnanantttnttnagggnnanataaannnnnnntannnngaangnnnntnntntntnaaagtannnnnngntttttntgaannnannaganagnngnnntttttttttnntnnnnntannagntttttttntgnnggnatcatantattntnncaaggaggggtannntattttnnaangatgaantttgnatntnanngcatnnannaannaaanttnntnatntngnnataatnaaagaattnaataattanangatanatacntaaaaaaaganncgagagcattnttnntgggatttttnatcatctcaaatnagnnannatatctatgaatgatanttanttangnttnataanntannnnnaanngtnttatnnaannatantgtnattnganntgananaanngatctgccangnangatntnatnaaatntntnnnngaanacantnncnaggcgnaatnatattnntantnantntntnattannaatagaaaaatntnatnatnatatanattnattatacantantatgntnnaaantatatnanntntttatactctactatatgaattattcnnanganatnaattanagnntngaataaatatatatatntanaatntnatttaatctgtannagantananacttncnaancatntctatgatatatgananagnntatattctgtacttaatngnatattanatatgataaatananagatatatataatattatnacatacgtgtatananttatatntatntgnagtacnngngannaatgattacttatatnantattnanatncnatanatatnnagggtatagtcntgtanaatgtgnnatcannngagtcnnnataatanntntatctgttatgttgttatatatttgntngnatatatnctactannnnataaggntataatttgngannagatgtnnaantttnatctcanagacatcnacatgcanatnangttgaanantgttttntatatctcatangtantctcntatngatntntagctattatntagaananntanatatatntnctctntatgtnnaatgactcataantctatnatgtnngtacaactnnctntgtatanagngatgnctcatanattacncnntantncngatatatatagnnnatttntatattnatactctantanntgatnganatattntatnnacnnanatagactactatantaataanatna

SEQ ID NO: 4617 - DNA, 805 bp, Homo sapiens
  misc_feature (1)...(805): n = A,T,C or G
ttctaatnccattctaaatnccagttccaagccttngtgcaggatccctcgattcgaattcggccgagaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtagganctgcacgatctgggaacctcacgtttatggtgggaggagtttaagatnaatttgctgctgnccaaaaatttgctggggtgcatgggctccaacgtggtgttctgtngagctgtttggactgggcaagcggcaaaagatctgcaacaacatgctgnttagctattagtattgattnggaactgcttgaactntgaaatcttgggaatcaggttaagggcttgacccaaaactactggcttaaaatcctaaatatganctcangacngtgtttngtcaaattgacacttantaatcctgtcctggantgatgggattggccttcccctcggctaataactatcagggtggattttggaaccacccctcatgggtaaaggatctggggattggcncaaganttttgntaccagcacaaaagangccccantccttnttggcaatcttgggcccatnagatcttncaggtngatntgtnccct

SEQ ID NO: 4618 - DNA, 772 bp, Homo sapiens
  misc_feature (1)...(772): n = A,T,C or G
ccntttcnaatncnagttatcgcntttttgcaggatcccatcgattcgtgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctncccacagccaccctcctcttcagagagcccccagccagcagcaggcccctctgcctgcactcctcaggcttgcccctcgctgcctcagtgaggcactagtgccactgccgtggcccaccgggccatagctcaagctgcagcagaaatgcctctcagtggccaacatgatgaaacccctgtctctactaaaaatacaaaaattagctgggcatggtggcgggtgcctgtaattncagctactcangaggctgaagcaggagaaccacttgaacccaggangcggangttgcantgagcccgagcttgtgctattgcacttgcaccggggtgacaaganggaaatttgtctcaaaaaaaaaaaaaaaaaaaactnganncctntagaactntagtgagtcggatttacgtanatccagacttgattagatncattgtta

SEQ ID NO: 4619 - DNA, 612 bp, Homo sapiens
  misc_feature (1)...(612): n = A,T,C or G
cnnagntcnnattnggttaangccctttctcgcaggangancccatcgattcgaattganctctnggctccngctgngnanagctancnngntntttnanacagccnagcangcnnggtngnatcaccaancntgggnccntacnanggcannatttnnggccngntgnatttggnnaaaagattgngnaanggcaangnttctgnctgcccaaggacaantgctgatgagcngaatnanctgggnacnaannngnttcacctgatnggtattnacctntganacacatnngtngccaaaaaatgggaataaggnnctgaggnactctcagaggcataatgnactatctgttcgtctntgatanaggnaggtgnatatgtgannagcccataanngagcatatttcaccaaaactntntccctgggtggtaccaccttggtcnaatgtngnagcaattngcaaaatngactangtncanacgatcctaccgtgntctnnaccaactctgatnatgnnnngnnctngtcttcattgcnaaaangaanctcattttgcnntantactacttgaacgacttagagtngacnnatctacccatgnagtcttacnat

SEQ ID NO: 4620 - DNA, 760 bp, Homo sapiens
  misc_feature (1)...(760): n = A,T,C or G
annttacnaaancnngnggacntnctctttctgcaggatcccatcgattcgggggcacaggccgagctggaaggagaatttggcaaaaaggctnatggcttgctggggatgttcctgaaacgcctcttgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaggcgtctgcattgtttccttttcttttgcccatncatgaatggttctggtttggntttggttttttttaataaggaatttcccggctggatttttgtgaaggcctgttttaaattggactttactttgccctttttggggtttctcaanttttatcctanaaacctttctgacttttttccatcnc

SEQ ID NO: 4621 - DNA, 612 bp, Homo sapiens; identical to SEQ ID NO: 4619
  misc_feature (1)...(612): n = A,T,C or G

SEQ ID NO: 4622 - DNA, 1526 bp, Homo sapiens
  misc_feature (1)...(1526): n = A,T,C or G
aggntcttgcttgncccatngcgaacgctggaaaccctcgnncaanagcgcgngaaaccncngggntaaatgcccacgnnnannncacgcnannnccccnttttcncacgcnacccacnagggngcngannagggncntnanangnacacnnatcngaaccantctntnaaagggncgncnaaantnnnctanngtncggcntnacgagngggaactgnaacccccgngnnngctacnagnnacacnagaaaacancnctngggtnaatacaacagccaacngncanncgnntaannaattcnncancanaggagagagacnnagnancgcncacacantnnngncccaacantggnaaaccacnagcncntaananancgacccangncanntnnctacaaganagnggcctcacngcnnanncnncacntcgtncgcacccnatnggaaccgcaantnncgaatcannncnnagggggccgccannncnnacactcgtntnacgngagcncgctcananaccntactanatnnngggcgcctngngaacaaaacaacangccccanaccgccntntagnnnccntnnaanagatanccgacggganactctannacgcganangnacngtccaaccactctagagggaaantgntngtnntananaancnacaangggtnttccntncgcancacaangccaaaatcnatntatgnacccatntncnctccacngggancancanggaaagaccgagnagcccaangacnananacngnngtanccntnaaacaaaccanannagacannanggnagncanaanccccccaggcaaancacnctantnngcanaaaacnccccctaaatnancgcgaaccctttgncgncnanngnatcggntngacagnnncanannnncnnncntnnanactcaaaaggnancaangntnganacnnngcaanaaaccagcaccgnggtgncnnaacactcnggcgtacccnnagcgcanntatatcaccaccccgggacangaaggtcncgngngnatatannaatcncntnncggcgacacgcanctctaaagcnncnnagntntaanangncnnatnntaanannangctctcaaaccnntccgcgnnannngncnctannactacgcaaccacatcaagnnccgnnatgcgnatccanncgttcacataaacggggngaccacnnngngncncnancganctntgtnnacgngnngcgagnnntnnnccgannngacangacnannngnaaanacgctaccctnggcnaangcacacatgngtgnaccganaantctgantatntncncntntacacncantaacnacncannagnntanngaggnaacccaantgaatngatanncncncncgnaacgnnganncccnnnnganantnaanntaagnacannnanagnntnnangcgcgcannacctntacnaacnncacannctngcnntcnaaaagancnacgccnctntcnccg

SEQ ID NO: 4623 - DNA, 797 bp, Homo sapiens
  misc_feature (1)...(797): n = A,T,C or G
ttgtnnnncccttttnaaatncctttggctanttgntctntttgctngatcccatcgattcgaattcggcacgagnnnggactaccttncaaaaccnggtngggaagcntgttacagaantgatntctantcccctgnattctggatgctgcagaccaacacctgccnacaanacncanacacacacanncaancantatcatgtaagacagnncgntnantnnnnnattntnatncttnnncatttacncantnttgtanantggntcatgngtctatanatnnttgtaantattntntgananangacganantctgaatcttaagcatatgctccatcnttnnatatgctntggtggagaggctngccntnattcatnttnncatggagncaagtttaatgcctctagantacattctgggcttcaagcatncttatttnnaactccctgagtgatgggtggataaatcnaacattgnctnagtggnntcaagacaactttgntggtggttttgntcacaatcatgaaaatggttnngccagataaatattttgatattagntttcntttttnatatanngcggtaggtttgaattgnacnttnaaatgnntngggttgtnaagacantggnttncaatnnaatttatnacatgaattggngnctcccctttggngaaaccttaaagaanttntgnatacttcttcataaaagggtgtgngatttngnaantttcgggggttttnaatttttnntgaagcttatttcntganaatntacttggnttaccaagcc

SEQ ID NO: 4624 - DNA, 797 bp, Homo sapiens; identical to SEQ ID NO: 4623
  misc_feature (1)...(797): n = A,T,C or G

SEQ ID NO: 4625 - DNA, 1133 bp, Homo sapiens
  misc_feature (1)...(1133): n = A,T,C or G
gctacnagcggngngaaaanntccnnccctttnaaagntccctggttaaaaaaaacccccctttttccccttttttggggnaaaaccnccccggtttttcgcnnaaaaannggncccnggggggaaacncccccaanttcggganangcgcaaaaaaatancntggnggnaccggnngggggaagcncnccncacanncggagggcaccanttttaccgngaatantgnnnnaggaancangncncnntgnttaccgggcgaagcccggacaangcnntntgggtnanaanntgggggnggaaancgngatccangggnccnccnacgcgcnaanggtagggannctnaaacaannnaaangtggngtccgntcnaanagngtngancccanaaaaaannncnnggtaagnntgcgnncnatacanaacanaacnnggaagcngatgaaataaannnctgtcatnananangnncancncacctggnnnacngggccgggaacncnanaagggnacanactcgnagaaaaaanaanntgnntngggncggggccgtgcnagccacnccaaaacaanangaannggatntngatnnggnaaagaanaaanattncnaaaancaaannnanaatgngnaatatgggggggggaagggananncggggannggggggggatccnnatcctctgttaaaaanggagngngggnangggggancgaaaaccnggnnaaggancccannatgtggaanncaggttntagnaaccaaaaaaancggnnnatctgnaggngncaanannancnttantcancccnnganngccntatnggngcaaggtggagaaatcncnggntaaanagggnncccnggtgggnagtggtgaaaaaaancccanggnaaangacnncaantngggccccnnaggggnangaanangggggaangntaaaaagtggaaaccccaaaannngngaaaagaaggtaattttttgnnnagaaccntttaancngagggccctccaaaaaaaaaatactccgcaaatnancngaanacntnactaggggcccannnagananaactnntcgngctanananagtgacatccnataaaaacggtntgaacnccncg

SEQ ID NO: 4626 - DNA, 1195 bp, Homo sapiens
  misc_feature (1)...(1195): n = A,T,C or G
agggnnnnnnnnnnnnagggtnnnnnnnnnnnttttttgggaaaaagnccccccntttttttggggaaaaaccccccctttttgggggaaaatttgggcncccnnccccnttttggtttttaaggggnncccaaaaannnnnccccccttnnggggggnnnnaaanannnnnnnnncnngggnnnncnnnnnnnnnnnncnaaaagngnnnnnnnnnancnnnntggnnnnnnnngnnnnnnnnttttttttgnnnnnnnccccnannnannnnnnngnnnnnngnncnnngggnngngggggncnnnnnnnnnngggggggggggnaannnngggngnnanacnnnnnggggggggaannnnggnnnnnnnnannnnggncnccnannnaancgnnnnnananccnnnnnganggnnncncnnannangnnngnaacnnnaccnnnnnacnnngnngngaannnngnnngnnancnnnnnnnnnncnngacgcccccgcgccgcnangaananaggcggccaacgnacaccaggaacgnnggcgnnaaagcagancagncgaccnnacgnagngcngagagcncnagnaangaacngagnaggganngnnacgnaccannnngnaggcccncgcnnnagaggngcaagnnaaacgnncgggagancaaaangacacnaaacngncanncgaancaaccgaannanggggnccagccnagacacgangcacacngnaanngagnangnnnacagacgaannggganacgnnannancacagnaanngncnnaaggccnccgganacaangggacgnnacngccngnngccncaaaggccngaagaaannnnngcgagacannccngcngngncnnngnanaagaggnagacangggncgannnnanggggaaggacaancaancnaaggagcgcnngnancacnnnccannggannagcancngacaanaannnanaaccgnnaacgnccngaaaagagnannnnagaaaaanngaangcaaacngaaccggcacncnccnnnnnncgacngcagacagannagggnncggnccnaacnnngagggnnnnncgaganacancggngaangcngnagnaaccgagnaaangncnannngacnannnggncancacncncgngannggcgcnnanaacgcnngncncaaaanncgcc

SEQ ID NO: 4627 - DNA, 729 bp, Homo sapiens
  misc_feature (1)...(729): n = A,T,C or G
cttttctaatgcttgggntngctctttttgcaggatccctcgattcgaatacagccctnncgntgncgctggntctgatggctgggntnttganncgagnctctngtgnangtncacacncnctcacncgacatatgggacattacacacacactcctgctcaaatgctgtacccatnatgngtggaanttctgnaggcctnagctctggcccntanggcggannnngcnactactttncatnaccncgacaccaaggtggctatggcctttccnacttnaactacaacgttggnngnggcanannatcntnattnannancaaagcttancangataggagagccnnataanngactgggaacntactgnnnacanccnatctgagaactcatgcggcacatggtggagncctatntgctcgaagaaactgtgttaacatgnactcatgtgcnnggctnacactcntngctgttncntgcnnatngtatacatgtatgacacttctgtctgtgnaaagtggaagcatttctcatacnggncctatgtctaatnagttntgaccccngnctgtagtngctaantgnaacaggnttgatccttacnntgaataactgtcacatnnttaatgagctggagaaaagtagtccaanccttagcccttctngggaaagtttgcccaacngtntgggagtncnaaattncttttnaggtnaaggcccctttntnn

SEQ ID NO: 4628 - DNA, 911 bp, Homo sapiens
  misc_feature (1)...(911): n = A,T,C or G
tantangannnntnnnnnnnnnngtnnnnnatcanatnnnnnntnntnnanngntcnttntntnggggntnaananangcgnnagtnnnngattttgaaaacnttataangccttnangcnatcgngtttntncagggncccntcgantngnnatcgggacgagccggantacgccntgtttggggttatgtgggtcggggtggccggtgnttcngccttcnggggccttgcngagactnacccctanancgtcgctgcccccagctcanctcttactgcgggcccgntccnacgggggaccatnctgtcagggactatgcggcccaaacatctccttcgccaaaagcangcgccgnnaccgggcgcatcgnggcggncattggcgcantggtggacgtncannttgatgagggactaccaccaattctaaatgccctggaagtgcaaggcagggagaccagactgnttttggaggtggcccancattntggggtgnanggaaannccnacccaaaatgnntncgaggactattgctatggatggnacanaaggcttggttaagaagcccaaaaaaagtactgggatncttggtgcaccaaatcaaaaatttccttgttnggtcncttgagaactttngggcanaaaatcantgaantgtcaatttgggngaaaccctanttggattgaaangaaggtcccnatcnaaaaanccaaaaccaaattttgcctccccnnttcattgctggnggggccttcccaagnaatttttnaattngggaaaaattggaaggnggtttggaanccnaagggaaaaatttttttgggtggnaacttggggtannttcnaaaggggttttggtccgaaatccttggcnttancctttcccnttnttgccccaaangggggng

SEQ ID NO: 4629 - DNA, 944 bp, Homo sapiens
  misc_feature (1)...(944): n = A,T,C or G
aaaanncanntacnnnnnnaannnanatnntancnaaaanntnattaannnntncggancncncnnncnncngttgattccaancttaatcaccntngantcngatatccngagccntcgatgcnncnntnaaacnatncgnangggngannccaaccnngggtctccnaangaacngcccncnggantgaccntgnaccctancaaagcaacnngncccanctntttgaaagggttctagggcangcgaaaaccnaataagnccccttnaaaaccnacangaaactnggccngatccctnaanncnccccaagnntgctnnccaccntnggnnntnttgcctngnangctnctgnaaccccctgnaacatnaaggangcnaccaggnaaaacacaangacattccnccnttaacntnggaagnaaaagccnnanntctaaatacanncccaaccagacccannnttggnggggtntggggaaanacctnngnggggggggngnaggngggnntaattaangntaanattantnnccaaaggnctcccaaaggccttgntttnnnccccctttnnncaaaaacaaangaaccntttttncnanggnctgnnntannnaaaaatnggggnccccccaaaaaaaaattncnntgntanggaancaacntagggcctggncatnncccnttaatcgggggccntggaaaaaaattntaaaatataaaaaattncccgggggnattngnaaacncnntgccnggnnaatttgggaangnnnggggtttctngttnaaaantnggtngnattngaccccanaaatntttttttnattatncaaaannnngtttaattcccncncattcttaaaaanttatcggggaancaaaaannatnggnnaaaaaaaccccanacaaanttnggggaaaaccccnnttanaaaant

SEQ ID NO: 4630 - DNA, 937 bp, Homo sapiens
  misc_feature (1)...(937): n = A,T,C or G
gttctaatgcttggaattnaatcgttggaaagagctagngattttngaaatcggtcataagtagatgttgtggannggaannaannttnggatactgattttntaagngtngttgtgnattggtcaggaattgttnannangnanataananttaantnaagatancatgcnantaacnnagatagaaanaannatgggggagtntntgatnnnnagnaantataacntnataagntnttattnncttacnanggtaaaagattttntgaaatggatnactnnntnagtttnnattntaatatggttnnagaancacttttttnatganncatngaagattnntnatanncantatattttntaannnagancttanngcatntatggcnatttnatttgtgcttttanntaagttttcttggatgnaagntatatnattnannattttatggtanntgaataganantngtangtaattttgatgtantaatagtngnttaatganaantttttnttaanannnttanttnggntnattnatntgnaantttntnggngntaaataattncnatttnttgaaantntncntttaataattngtatattaaccntngaacaagataatataattgnnaacagntnttattnaatattntanaatanttntgaatannngtanatnggganataattattggggtnnatngtanttgttttcnacgtaanattttaatnngtnaaatntgtattnnnaaanncttgnntgtaantnattaangaccgcctanatttaaagttnnttagtnaataaattnggntttgggnaanaaaatattntatatttataananatnnnannaattnanntctttaataaatttanangnntntnatatatntaatnatattanttataanttttgtatannagnaa

SEQ ID NO: 4631 - DNA, 937 bp, Homo sapiens; identical to SEQ ID NO: 4630
  misc_feature (1)...(937): n = A,T,C or G

SEQ ID NO: 4632 - DNA, 1191 bp, Homo sapiens
  misc_feature (1)...(1191): n = A,T,C or G
tttngnaaaaannnnncnagagggtttttgccnaaaaaatnggcccntttgggggaaaantttgcaaaaaatccccntttttggggnaaaaaggnnggccnnnannnnnnanngnattnngangangnnannaaatnnnnnnnnnngggnngggngnnannannntnangngngaangagggggnaaanttanannannagnnnnnnnnntntanannngnnnnnnngnannanannggngtttanannnnnnnnngngnnangnnnnnngnaangggaggggnnaanannnnnnanananaggggggggggngnanacnnnnntanacgnggnggggnnnnnannnaaangagganannncnagnnaganannananangagaannananaanannannangagantannnnaannatanganaagaggnnaaaggnaccgnnaggngggggnntgntanacannntganntnggcnnancaacnaatcanacatgactgagaatnggnntacnaantannaananctanngagaantgganggaaagangantcaagaatanaaagggacaacatgagnaaanaangacacgntatncgaanatnngaagaaananaaanagncggcaaanatangntgaatagnaaatnnnnacgngataatannanannntanannnagnnaccatctngaagcaagagtnactnngtnaaacgacantanatnngagnagagnnnntnnnannnttcnantagnggnagacnacnatannantantgnntanaatnctncgaaaatntaactancnaanacntatatgaatgagannnatatctantnngagacantncnacgacnnnnnngtggnaaaannnacannannngtgntganancnngatgtgtcacacacangntgntnnactntannnnattagacntnangananantatccgagntnnannannaanantnntgananatctagaaatatngatnacanatnaaaananatatntctagcncatcatgagatatncnancagangctgancngaagatanncgagagtctacntanatncanantaactgnatnnanataagcannatgatanatantgncgtnancnnnagntaanggagaagactanntngtnatcnnntngaaancctaananacatgnca

SEQ ID NO: 4633 - DNA, 1191 bp, Homo sapiens; identical to SEQ ID NO: 4632
  misc_feature (1)...(1191): n = A,T,C or G

SEQ ID NO: 4634 - DNA, 756 bp, Homo sapiens
  misc_feature (1)...(756): n = A,T,C or G
acttaganggntgaagtgaaanncccttctgcaggaagcccatcgattcgaattcggcacgagagcagacgttgaaggcattcagtataaantttttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacangctattttatctcttgaatcagaacaagtgccattaatgtcagcacactggtgcttaaaaaacaccttcaaagttggacccgtgccggaaatgattgggtaatttggggatattactcnggccaagttattcctcaaaataagagacccgttcacatggatccgagcctgcttaattcangggggnccacaatttaggggaaaatctggttncaacccactgggttatncctggccaaaatgggccaagnccagtttnat

SEQ ID NO: 4635 - DNA, 820 bp, Homo sapiens
  misc_feature (1)...(820): n = A,T,C or G
gnnnannnnncnngnnntttnaannccttntttcaaatgcttggctactcgttctttttgcaggatcccatcgattcgccaatggatgcagganaactgagatgggattnccncacgttgcccaggctggtctcctgagctcaaagcaatccanattgctgggattacagctgngagccaccgtgcctggctgagatgacttttaaaaanggactnctctaaagtagaaggaagggtggaattgtatgcacaagaagaaaaaaacctgnaagaaaaacatactaaagaggctggagtgcaatggngcgatcttggctcaccgnaacctncgcctnccgggntcaagtgattctnctgcctnancctcccaggtagctgggattacaagcatgggccaccacgcctggctaattatgtatttttagtanagacggagtttctccatgttggtnaggctggtctcgaactacccgacctcaggtgatccacccacctnggnctcccacagtgctgggattacaagcatgagccaccgtcccggnctccctgtnncagnntctataatntgttcntattatattctgggtatatgtnggnngtgtgattattcatgtgganctattntcacattctttgnattaactatnatngtccttnaatggtntaaananaaagtttcattcctacaaaagnnggttttggtccaaataaccncgggttttcaaggttaaccaatcnttgaaaaaaaaaaccttnanttcnattntaaaaaatnaaccattttaaaanttngccnantnccantttaaaacattaaaan

SEQ ID NO: 4636 - DNA, 778 bp, Homo sapiens
  misc_feature (1)...(778): n = A,T,C or G
ttctaatgcttggnttnaaacccttttaaancccttgcacttgctctttntgcaggatcccatcgattcggagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagaagataaagctaaacgtaattattatttaaatgaaagctatttttttaaatgaattgaaatttttcatgatgctactaatttgccactaaatactgcaaatggtcaccctgnatctcttctgacattgggatgttatttgcttatattcttataattttnaaatgaaggcacagtngaaatggaaaattttatnctcnatggttcctggttatttttaaatccttaaccancaaaattttggccttaantttctttttatatatacccncnn

SEQ ID NO: 4637 - DNA, 750 bp, Homo sapiens
  misc_feature (1)...(750): n = A,T,C or G
ttnaaaatcgcttggcnactcgctctttctgtnggatcccatcgattcgaattcggcacgagccaaaatggggtggggcgcagtggctcacgcctgtaatcccagcactttgggaggccgaggtgggcggatcacgaggtagggagatcaagaccatcctggctaacacggtgaaacccnggtctctactaaaaatacaaaaaaaaaacaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaagaaaataggcacaataagtaatacatttctgcccaagtaagagccttcccttttgtggatgtaatgaaaatatcttcaagcactttataaataaattatatgtctgatactagccttccattgcctggatcacatctgattgtcctggtaatttgagaaaagggtagccccttggtatggatagtagcttgatgacatggaattcanggaaaagactatgatggtgtcacttgtaactgcttttggtgctgtaaaatggcatggatttaagaagagaattggctgggtgccgtggcttacacctgtaatcctacacnttgggaggccaaagtnaggctgctttgacccagaatttcagaccaacctggccaan

SEQ ID NO: 4638 - DNA, 827 bp, Homo sapiens
  misc_feature (1)...(827): n = A,T,C or G
ttnnnnnnnntnttcaaatcctttgctacttgttctttttgcaggatcccatcgattcgggcggaggagcagaagctcaagctggagcggctcatgaagaacccggacaaagcagttccaattccagagaaaatgagtgaatgggcacctcgacctcccccagaatttgtccgagatgtcatgggttcaantgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggangaggaagtgcccagtttcaccatggggcgatgacaatgtttgccacagccttntgcctggaacctggctcgtgcttgtgaccagaagggaaaaggcngctgttttggctctttcttccccgcaanggaccccgnttgaccccgccttggattggaagaagccaaaagggagaacccccttttccggaacccggtttaacaagntcccttggtntttttgggcannggnttttngggaaacccttgaanggggcccttttttcccttggcaacnttaaaaangncaccttgnccnttggnannaacanccattccggngcttcntcc

SEQ ID NO: 4639 - DNA, 827 bp, Homo sapiens; identical to SEQ ID NO: 4638
  misc_feature (1)...(827): n = A,T,C or G

SEQ ID NO: 4640 - DNA, 769 bp, Homo sapiens
  misc_feature (1)...(769): n = A,T,C or G
tnttttcaaatngattggctacttgttctttttgcaggatcccatcgattcggaactcagaacactgagtccctatttgatgttaaaatatgaccgttaaacttctgggtaagataatgaatggcactatggtttatactgtttctgttttatgggctcttccagagacgtgaactggaaaacnctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcangcccagggcagccccatgggcccttaaagcttgagagcctttcctgctgagtctgagagatgccanaagcaggagaggttagaacccgangagggcccgcacctgcgctgctggccttagaggaaggcccgangantgtggtggcccctaagcagcttnggactggggaccttcgtcccaccctgcaaagaaactggaattctggcanaagcccccattatggaggaaaagggaaggatcctgcccttggcagnacctttgaccctntggaccttcacaaattgtnaagcctgagggttttgngtangnacccatnaaaaan

SEQ ID NO: 4641 - DNA, 769 bp, Homo sapiens; identical to SEQ ID NO: 4640
  misc_feature (1)...(769): n = A,T,C or G

SEQ ID NO: 4642 - DNA, 772 bp, Homo sapiens
  misc_feature (1)...(772): n = A,T,C or G
ttatttgaaccctnncccnttcaaactccttgttctttttgcaggatcccatcgattcncttttccatgactccaggctgtgcctctctccatgtttggtcccttctgtgcccatggtcaggagctattcgggtggcacctngctggccaggctctcccgagtcgtggcacctccacaatgtgaattttctgaatccctattccaggattnctgggaataatgtttacttctanaatggncctgntgtaaaccatctcatcnaggtgtggtaaagccattgnatgatgaggggactgccatggaaaggagagtttgttacttacggttctgagaggaggggccacataggaaagccccacggtgggtcacaaagcggaaggagggaggggaacgtgtgggcttgntttttctngcacatctctgaagagttnttaatcttcactcatcatgtgccaagaagtgncatcataaaangaaatatntttttttcctaggagcagngttaaaatctgggtcacattcctgaccaaggacagcatcctgccttntgcccatncncttcagttcacaaaagctgacattttaaacaaatcatgactcacacgtnttaattgggtataaaaaatgttgnggtacacctggttagataaaaacttaanggccacaanggangggccccaaggtanncgatgtcaagtgtgtnaaaggggcctggattgggccntggnnaanggatttttgggcaaaacccaaaantttttgngcccccnn

SEQ ID NO: 4643 - DNA, 710 bp, Homo sapiens
  misc_feature (1)...(710): n = A,T,C or G
nnaacngaaccttgcantttgacttcctttacgcatncgcangatcccatcgattcccaganatgcncaccagccctgcacggnaggtttttcctgaacctggctcatggatanagaancncacgagggcataactgcctgtccgngaaaanccaagctanccnaccttggtcnnctttgntgtgnnncnnnntntgcnaagntggtgaaaaagaaagagatccngaccanagaacttctnnanggatggacntgctnactggggaatgngncgcccncnntacttgcacantanattcgaaanngtgnaggntacacgacattntgacccgctcaaattgcagggctcctnacgcnacgcttctntagctttctacgtttcnttntcnccacngtngacgcntttccccgggaagntctaaataaatgngctccntntannnntncgattcnatcgctatacagncncctgaanaccngaaaaaatttgcnggnntgtggtgcacgtaaanggccnctnncngggaacagttattgacctntncgatggaaancanggntttaaactggntcnnngnggaacntgaacanactaaccttcnagtcnatnttttttggttacggaanntntaantgggctnncttnanaatctctgatannatggtagnngactncacgattaanctacaatcnttcttttngggggaat

SEQ ID NO: 4644 - DNA, 1315 bp, Homo sapiens
  misc_feature (1)...(1315): n = A,T,C or G
anggngnnnttttttnnnnntttttttnnncccccnttnntctacnnnncgtgggaaaaaaaaatcccnncntttttttgggggaaaaaaaaantcccccccccccnnntnncggnncnnnntttttttttggggggnnnngtnnaaaaanngnnnnnnnnccccnnnnnnnnnnnnnnnnnnnnnttgnnnnnancngnnnagnnnnnnnnntnttnnnnnnnnnnnnntnnnncnnnnnnnannnnttttgnngnngnnnnnnnnnggggggnnttttttttttttggggnnanggnnnncnnnnnnnannnnnnnnnnnnnnnngggnnnnnnnnnnnnnnngnnnnnngggggggggnnnnnnnngtttttttnnnnnnaanngnnnnngnnnnnnngnggggnnnnngnnnnnnnnannnnancnnnnnnnnnnnnnnnnnngnnnnnnnnnnnnnnanannnnnnnnnnnnnnnnngcgnggggggggggggggncnangcngtnagggganccacgagnnggaggngtggggccannatgtccttngancgcgtctgcnagnaacnctncgaggatgancnanagnnccannnanggnncnggccagnntagcncagnnttctnannnctaantgngcggatcanggggnntntncctaatagngtgnnggctaanannatgnatggngnnactgatggngaaacanntctnancgtantnccangtagtgaatgctggnttantnnntttagnggntnantagcannngcggnnaacnnanngtggntcntnnannnnanttgnnannngnngggnttcnncntnngnaganngntntnaggngncnnnncgntaaagtccnnnannangtgtntaanctnnctnaancgggtatannnnnnntnnnnggggtnnngnnnttcnnnannngnnngnnannntgnnnnnagtntgngnntacgannangtnnannancangnnannnattgtnnntnngnnnnannnannntntctgaactcgtacnnnganancnnnggtnnnngcctcacanngtatngtangctgnnagngnantatannntaagnantnttcntnnncganttnntnncgtnaacgacgatntnngtanncncgnntaanngcntaanngcanatangtnatagngagattcctnagtngaccnaggnnatgatatnaangntcangnannnannntnnnctntngactanangagannatgananatggntnnctngtgnnnagnatntgatntctcgntgctcncnagnaggntaacacacc

SEQ ID NO: 4645 - DNA, 791 bp, Homo sapiens
  misc_feature (1)...(791): n = A,T,C or G
ttgaaanncccnttagnnnttnnttnncnnnctctcaaaaccctttggcaactngctctntntgcagggatcccatcgattcgaattcggcacgaggctgccacaggggggcaatctttatttgtcttacttcctaccccttccctgttctgcctctttaactcagttaagttgttctgtttgggacctggaaaagaacccaaagaaaacctgaccggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgntttcacttggtatcctggagttgggttgctaaccttaatttctatgatgttttctaaaatgaaacttgataaagtagaccaccagctgcacccgtgttttctgnaaaagtattggtagtaagtggccaagagacttgaggaaaataccagattttttggntaccttggncttggtttaagtcttaaaaaattaaagataacattataatgnagaatcanatggggcatannccttggaaagcctnccttgaaaaaggnnttaaatatttangaagcctttaaaagacacttaaatggaccctnaaagacancn

SEQ ID NO: 4646 - DNA, 791 bp, Homo sapiens; identical to SEQ ID NO: 4645
  misc_feature (1)...(791): n = A,T,C or G

SEQ ID NO: 4647 - DNA, 1427 bp, Homo sapiens
  misc_feature (1)...(1427): n = A,T,C or G
nnttntttnggaaaaanttttcccccttttttactnntaanacctccggccattggccctgggccagggggttccggggaacnttctttaaggnanggggnaatncccccccgggggtttaacccgggaaggcccttccggaaaatttnccggccccctttaattaaggtgggaagnttntntttattttaacaaaatttncaacttggggcccggtccggtttttttaacaaaacggttccggttggaacttggggggaaaaaaaaacccccttgggccggtttaccccccaaaactttaaatcggccctttggcaagccaacaatcccccctttttcggcccaagcnttgggcggtaaataagccgaaaagaanggncccggcaaccggaatccggccctttcccaaacaagtttggcgccaacccttgaaatnggcggaaatnggaacgccgcccccttgtaagccgggcgccaattnaanccgcccggccggggtggttgggtngggttaacgccgccaagccggtnggaanccggctttacaactttggnccaagccggcccccttaaaccggncccggctttccttttttcggcntttttctttttccccttttcccttttttctttcggnccccaacggnttttcgggccccngggcnttttttttcccccccgggttccaaaaaaangggncccnttttttnntttttttnaaaaaaaaaaaaaaaaaaaaaaanatcngggggggggcctttnccccctttttttaagggggggttttcccccgnaaattttnaaaatngggccntttttttaaaccggggggaaaaccccnttttngggaaaancccccccccnaaaaaaaaaaaaaacctttttgggaaanttttaaaggggggggttnggnaaaatngggggtttttccnaaacccgtttaaaanttngggggggccccaaantttngggccccccntttggaaattaaannaaaccnggggnttttttttttttccggnccccccntttttttggnaaacccttttttnggggaaaatttcccccaaccgggttttccnttttttnaaaaaaaaagggggggggaacctttntttttgggttttccccnaaaaaaactttgggggaaaaaanaaaaaacaaantttttaaaancccccccnttttnttttttttttggggggggggccccnnaaaattttcccntttttttttnggggaaaatttttttaaaaanaaaaagggggggggaaaattttttttttggnnccccgnaaaatnttttttcnngggggnccccnttaattttnggggggnttttnaaaaaaaaaaaaaaattgggggggnccttggggnnttttttttaaaacccnaaaaaaaaaaaantttttttnaaaacccgcccg

SEQ ID NO: 4648 - DNA, 1505 bp, Homo sapiens
  misc_feature (1)...(1505): n = A,T,C or G
tttttncccaaaaaaaaaaatttnggncccccttttttttttttnaaaaaaaaaaannnnngncccccnnttttnnaggnnnnnnnnntttttttnnnaaaaatnannccccccnntnannttttttttncccttaaaaaaanagnaaccntttngggggcaaaaaaaatcccntccnanaaaattnnaatnccatacaattaaatnnagnaanngnncnnnaangnnnnnnnaaannnnnnnnnnaaaatntannnangnnnnancnnanaannggnncngnaaannggggacaccnngnnnnnntggnnnggntnnaaatgnccnnnccnnnnaaggnggntngtncnaaannnnttngnaannncacattngnnnnancnanaaanngnnnnnntnnacctnaacantggggannnnnnnnnnntnnnaanacnncatnananaaananganntgcncaannnaannaagngnnaanannnanatnnacnnnaagcacnaacnncnancnanaaaaaaaaccnngnnacacntgntaccactcanggctngnaccnttatgngnncaatngatgnnnannggncgcactacannnannngnnccaaggnccacaganccacnaatcanacntngtaatntaatgcancnnngncngcaatannnagaccacnttnnnnatgacanngcaaanacngncannntancaannggaangtagtnacagtaacatangancctnaantaacctatagcngggatnccagaactaaaatactntanctacatgnaacnttatnaataagaanannggatnaaatannatagtaatgngnntcttanatnatatctcacaaacncgatcntagaaataaataaatcgtagnanttnttatatcnatanaanagattcatatanantnatatatctatataatcantatataaacaacatatagnnntataaaaanaaatactaaaaantcaananntanattanactcnnaanngagggcaaaataanncgnagnanaatatataagtnnnantcacatanatnnanaaaaanatatacaatatanannaaaaaananatangaaaananaaaanctaaatannaacnnatanatataaaatatantcnnaaaacaatatataanatanaaatcnanatntannganataaagatnaaananatnntntaancntncnnacacataatntaanntaatnnanaaaantnancttanngntganaanactanaaanatcnaaannnnatcaaatatanggnnaanaatatanaatatataacnaatgngaaacattcaaanactannanatnnanaaananatcttaataanaaatatanananataanaataataagannntaaanactaaaacacctatntctaaagtcactanatcattngnnanacanatctataatnnaannataaaaaaatatgnnntnnnanaataatattntatcnannnc

SEQ ID NO: 4649 - DNA, 759 bp, Homo sapiens
  misc_feature (1)...(759): n = A,T,C or G
ttantcatcnctcttgtttgantnccntacaactacttgttctttttgcaggatcccatcgattcgaattcggcacgaggtgagccgaggttgcgccattgtactccagcctgggcaacaagagcaaaactctgtttcaaaaaaaaagaaagaaagaaaattacctggaattcaatattgccatcggctgatttaattctaatatgaanaaaggggcagtgtgatgtgccatggagcatncacaacctgccatttcacccaccaaccttagaaagccattgaaaagagttgtttttaatggtgtttttacatccagcttcccacacctcaaatacttggggtggaattgttaatctcacattgcagtacaatgaaaatagtggaatggaaatcaagttataaaatggagctaaatatttcttctgcttgcctctgagttgacaagataccataagatactgtacatgaggctgggcgccggtggctcacgtcttatttcttctgcttgcctctgagttgacaagataccataagatactgtcatgaggctgggtgcagtggctcacgcctgtaatcccagcactttgggagggtgaggtgggcagatcacctgaggtcgggagttcaaaaccagcctgactgacatgnagaaaccccctcttttctaaaaaatcaaaantagcccaggccttggtggtgcatgcctataattncagctactcnggaagcttangcanggaaaaaaaaaaaaaatttccn

SEQ ID NO: 4650 - DNA, 917 bp, Homo sapiens
  misc_feature (1)...(917): n = A,T,C or G
ccncctnntttcccccttnnnnggtgggnaaaanaaccnncttttttgaaaaaaaacccccccctttttttggnaaaaaaccccccgttttacnanaaanacnggncncgagggggganccccccncnccngggnngggngngangcnnnnactngncnacnccacggcnnaacacncaaaaactnggnngnggattntattgagnggnaaaagggacganggctgngcanagnnagagaaanngggcnagcccggnaacgacggangggnaaaaatatggggggnnnaangacaaaaggaggccctgcgcnaanccgaaccatnannanncccacgtagcccggcccnaccnacgaaccaanncctaacagaancaanatgnggcnggganaaacagnnnaggnaaacaaggattcgagaggangaggggggaacaagcantngtgggngangtnananaacanggggattttcnaatgagaanaatgcanggcngaannatcncgctgggnatggagggnacttgcnccgccagatcgcataaaacgcacgcaactgngccacaaacatacggangantgngcaanncnaaannngnngccccgantnacctgaggaggganctaangctttgggaaaagaacaaaanacctnggacnggacaagggngaaggatgaacangaagacccggaaacaagaggaagggganncgccnctaaanntaaacacatccaaangcgnnaaggggaanccttnggncnaanngaggaaacctgnaccctnacntccaaaccncgnttttaagaaagggggaaaaccaaccnntgaagcnantnccccccnnngggggnaaannaacnacctgggcccaaannntttgaangaacngananggnaaacnaagggnaatggggg

SEQ ID NO: 4651 - DNA, 1282 bp, Homo sapiens
  misc_feature (1)...(1282): n = A,T,C or G
agnnnnnnnnnattnnnnnnnntttttggaaaaaaccccccttttgggnaaaaaaanggcccccgagggnnatttnnaatttacccccttcntnnttgcaaaaanccncnttttggggaaaaaanccccccacancgncnnntttttgnggnngnaaaaaaggnancccgnnnnnnanggnanctannnnnnnnncncnnnggcnnanngnnnnngnggncnnngnnngncnnnnnnaannnnnnnnggggttttttnannncncnnnancnannnnnnnnannnnnnnnngnnnnngngnncnagnncgnggggggnnnncangnanaanngggccnngnnngngnangnaanngnnnagngccaannacnannaagnnnannaanggaccnnnnnanannnanangccnccccccccccanaacaagnacccatgacnnnnaatgacnaggncctaggnacccanaanccaagcccnangnananctgncncaggccangaacaccagccaaagaanngagcaccccnaaccacnagcncancnagggaaancaggnncaaaggncaaaggnaactaaccaaanaacccccantaagggccaaaaaagcctnggagcngcgagnanaannaaaaangcctaaggnngccnanggccngaaaaaagangcgnanaanncaagggaccanaagagnaaannaangncccaantcncannnaannananagngcncccccaaccannaagatcnnaanccnggggnannaaacnngancaatcgnncncnnnncncnanncggnacnaaananaaaancggggngaccaagnccnaaangcangannanaaaanagntacangntcgnncatnaaaacnanancacgngaaaancacacnncaanncaancngnanannnggggagagnncacnnaanngananaaannacnacncaccacanaaggngancnacnggccnggannnanacaananggcanaaaanngagncaccgcagnaancngcgananngcgcnncacnanaacgnnagncnnaaaagaaaganacnaannacangcanngacncacgancnananccccaaacnaggnnanacncaanacacntnnngcagananaaccacnnnagnacacncacacgctacaagngnatnanagcnantataganantacanacncnanacanacngcatnanncacaacnatacngacanacngcanntgaaaaatnnggaannnanagaacggagagnacaaccn

SEQ ID NO: 4652 - DNA, 1282 bp, Homo sapiens; identical to SEQ ID NO: 4651
  misc_feature (1)...(1282): n = A,T,C or G

SEQ ID NO: 4653 - DNA, 1356 bp, Homo sapiens
  misc_feature (1)...(1356): n = A,T,C or G
tttggggaaaaaaaaaaccccccccctttttgggggaaaaaaaaanngnccccccngaaaggngnnncttttttggnaaaaaaacccccctnttttgtttttgcnaaaaaaaaccnccnttttggggnaaaaattncnccccnannnncgncccnantntttgnnngaannggaanangnnnananncccnncnnnnnngnnnnnnnannnnnnnnangannnanaanaggnnnncannnnannnnaannananaatnnnntnnannnnnnnnnggggggggcnnatannanannnannaaaaaannnnaannaaaaccanangggngnanngnnaananacnnnanaanaannannnnannnananggaaaanannnaannaaannanaaganannnnnnacaaanncnnaaannngnaacnannnnngnaaacanagnaaanaggaannnanacnacncaaaaaaacacngggacnaanaacanganagnatnnnacaagncaanacaacgaagaagacnnataaacangcacaaaataancaangaaagngnaangngnaaagnacnanggnaanaanngaatacaggaaaantnanataaagacaantnngaatagnnaacancaaatcaanaangnaaggaacnnnctanacaacacccaananngaaancaagatanatactaganntanggnacaanagnaaaaannannnnncangctangagganngngnnaaacgaaaannacaacaaaacgacaagagancacaangangaataaangcaananacacnaanacgaaancaaaagaangnacccncnangaanaagagacnnnngaangaancgaaanannaacgcnnacagacnanntaaggacncacataangaancanagaaangacgancnaganaggggnaaananancnccagnagctaacaaaacagnaaaatanngcacntannagatnnannanangaaacanacaangcaagngcatnnaaaganaaagaataanaanacannnannanaggccnaagaannnaaanacnaaaatanaaaagnacatagacatanaccanacagnnnaaaangaanagntacgnanacaanaaaanaaaatcacaaannccnaaacgcnacnactaacanacatatcaacnngacannnnnnacagcaaaacagannnnanganaaancacnnaannaagagaatannacanaccangaatatgtananacannnacaagagacgnaatagnnaacaganatcacaacacacnnanatatacgcnaatnnncacgaanngatatgaannacacannacncgtcacaatcacancc

SEQ ID NO: 4654 - DNA, 1356 bp, Homo sapiens; identical to SEQ ID NO: 4653
  misc_feature (1)...(1356): n = A,T,C or G

SEQ ID NO: 4655 - DNA, 1326 bp, Homo sapiens
  misc_feature (1)...(1326): n = A,T,C or G
ttttggccnaaaaaaaaannnnggccccnttttggggggccnaaaaaannnnnggggcccccnnggnggngnnnnntnntttnnnnngnttttnccccnnnnntctttttctngggnaaaaanccccccttnntttgggggaaaaaaanncccccccnnnnngnnnnnttttttttggggggnaaaaaaannnnnccccccnngnnnnnnnnnnnnnnnnnnnnnnnnnnnnnnnnnnngnnnnnnnnnnnnnnnnnnnnnnnnnnnnnnngggggnttttttttnnnnnnnnnnnnnnnnnnnnnnnnnnnnnnnnnnnnnnnnnngggggggnnnnnnnnnnnnnnnnnnnnnnnnnnnnnngnnnnnnnnnnnnnnnnnnnnnnnnnnnnnnnnnnnnnnnnnnnnnnnnnnnnnngggggggggnggngnggnngnnngcnnngnnannggnngcanngngnngnnnannggnnnggnnnnnnngnannnnnncnnngnngnnngnnggnnnngggncnannnnggcnnnnnnggggggnannngnnnnnggnannnnannnngggggannnggnncgnngngnnnnngnganannnnggnngnanggannnannnannnnnnnnggnanccnnacnnannnnnnnnngngcgggaancnnncnnnngnnncnnngacnngggnnngnnnnnnnnnnnnnnnnnngaanggnnnnnnnnngnnnnnnnngannnnnnnnnnnnngngncnnngncgnnngaagnngnnnnnnngnnnnnnnnnnnnnggggggggnnnnnnnnnngnnnnnngnancnnnnnnnnngnnnagnngcnnngnnnnnnggnnnngcncnnnnnnngnnnannnngnngnnnannnnnnnnnnnnngnggnnnnnnannnnnnnnnnngnnnngnnnnnnnnnnngnnnnnnnnnnnnnnanagnnnnnnnggngnaangnnannnnnnnnnnnngngngnnnncgnngngnnnnnnggnnannnnnnnnnngnnnnnnnnnnagggnnnnnnngnnngnnnnngngnnnnnannngnnnnnngngnnnnanngnnnannnnnngnnnnnanncacnnnnnnnnnggnnncgnnnngnnngnnngnnnnnnnngngnnnnnnnnnnnnnnnngnnnnngnnnnnnnnngcgnnnnnnnnnnnnnngnngngnannnnnnnngnggannnnnnnnnnnnnngnnnnnannnnnnnnnnnnngnannannnnangnnngnnnnnngnanngnnnngnnnnnnnnnnnnnngnannnnnnnnannnnnnancgcgncc

SEQ ID NO: 4656 - DNA, 868 bp, Homo sapiens
  misc_feature (1)...(868): n = A,T,C or G
gnnnnnnnnnnnnnnnnnnnttttgggaaaaacnccctttgggnaaaannncccggggnnntttgaaannccctcctccggaaancccctttgggaaannnnccccnngncngttggganccnancgacccgaatncggcacgagccgaggaccagcgcagcgaggagaaggctncagcgngaggccaacaannagancgagnagcagcngcagaaggacaagcaggncnaccgggccacgcaccgcngnngcngcngggngnngggggaacncgggnaaagcaccanngagaagcagatgaggagccggcangtgaatggggnnaanggagangagaaggcaaccagannagagnggactncattctgagngagangaacgngccngactntgacncacctcccgaagnctangagcatgccaaggcnctgngggaggatgaaggagngcgagcctgctacgaacgcgccaacgaggaccaagctgatngacngngcccagngctncnggacaagaacgacggggagtaagcaggccgacnangagcccgagcgaacaggacccgnnncgctgccatgncngactnccggaanccanggggaccaaganccaggnggacaaaggcaactgccacangggncgacgnggganggccagcgcngaagaangccgcaagggggaacccaggngctnaaaccgaaggggaactggcnancagnnnnngngggggggccagcagcnacnnaccaacanggggcaanccgggaagggaaaaccangancaacgcgccngnanggaaggnaccggaaccnngnanaagaagcaannngggaacaacangangggnnngcananccatcncnncn

SEQ ID NO: 4657 - DNA, 1319 bp, Homo sapiens
  misc_feature (1)...(1319): n = A,T,C or G
cccnaaaaaaaaanangnccccttttgggggtcaaaaaaaatcccggccccaattnttnnnnnnnttttttcaaaanaaaaaaccccccctnacnttttttnccaaaaaaaanccgcccntttggggggaaaaaaaaaccctccncnaaaanncngnncntncaattcaanaccnngagggnnatnnngccccnaaannannccnnaangngnnncantagnnnnaaanannngannnnnnncncaatnnnggnngnccnnnanacnnnnnnnnnngncnnannaannanacnnnaaggggggaaantncntnnnnnannannaaagggngnnnnccaaaannnnaanannnngnggnaanananannnngnagnacnngaaaccncnanantncnnnnnnaannacannnaccnannanancnnnncannnnccnnnnnnaanannannagnaaangnnannaaancgaganancnaaacnnnnananaacccacanncaccagaacacancagnacagncaaancntcacatananaaangtgcantacnncnatatcccgacacannccnanagacnaaatacaacngatnnacncannanannaccnancnaaaaaacaancacaaancaanganaaaanaacannnaacgacactaanaagcacananacgngccnacaanacccnacacaaaccnnacngccaannancnaaaactaaaacngaatatcacnnacacnnnnnaactncnacaaaaacnaccaccngnaaaaacnnnnngnaaaggngncancaaatngaaaaaacnaaaaaaannnnaccangcacannaaaacnnntnnacnatgacanacaaanaaananacnntaaaannnaacaannacaacncnaacannttaaanncaaaannatancccgcagcnaaattaatangnnanancntcacanannaaannaacnaaccccantgtananaaaccncaatancaccacnanatanncaaaggtaanganaaacccanaaanaccanatntnaaacaagcgncaaaccanaacnngacccatccaannatncnaacacaaanaaanatatncatnaaacacacacaanaccacctcnnnaannnacntaccntanaaacatncaaaanctnnatngacacnnacaaaacagcaccanntcaanaccnaananactacacagagatacanagacaanntnnnnncnnagaaaccacacgacccatnanacnnacctntcncacnacncnntcnancgcgggagnnaaaaataanacacanaaacacacnca

SEQ ID NO: 4658 - DNA, 1088 bp, Homo sapiens
  misc_feature (1)...(1088): n = A,T,C or G
gaggnntttttccaaaaaaannccccagagggnnnatttttgcaaaaaacgccntttggttttacaaaaanccgctttttgggnaaaattttngggccngnaaaaagnnatntntngggannnanaanaannnnnaanngganggganannaaannannnannnnnaannnannnnanaganaanagggngnnnangnnannttttnnnnnanngangggggaannannnacnannggggnganannannnnnannnnnnannngggngggnnnanannnaannangngggnaganagannnannnngnnnananaccnnagnnnannnaganannnaaanaaannccnnannnananaagaaacanaagnnnaaaanacaggaaaaaaaaaganaaantacngnaantaanacaaaaaaaacaaaacnancatngnancaggnananagtagcaanaacnganngaaggcanaagagagaaagncntgacnaaagaggangagntnnttnaactaaganagagannnacngaantgnaaacangaancnnatganaaaaaaggntnngacanaagaagaangcnanacannaaaanganngaagnatgaaagaaaaannnaaagcntnggnanaaaaaaanagagatnaanaaaaaatnaaaagaanagaannaacnnaatntcngnnaancncgagaaaaatggnnaagaaacangaanaanatacaagaacnaaaganagnncggaaanaaganaggnanaaagaacnanatataannganaagntanacanggataacangnagatganaangagnacannanagananatgnangngacnanagggagantaaaaanntaagnnannaaanananaagcnanngagannnnaccngnanacgggnannacataacanactnannnnanaaaatacnnnaaagggagananacgcanaatnnngcanaannannananaacgaagaatangaagngannncagganagatagaaananganntagaacngaaannaaantnnncaaancaatnanaaanagncanngnacatanaaaacaacnn

SEQ ID NO: 4659 - DNA, 1267 bp, Homo sapiens
  misc_feature (1)...(1267): n = A,T,C or G
aggtttttttgcaaaaaaanccccccntttttggncnntttttgcnaaaaaanncgccttttggttttnaaaaacaccccccttttttgcnnaaaattatacgcncagtnannatgnnnnntatnnnnnnnnannnanaannnnnnannnaananaanngggngnnnannannnaaannanaannnannnttttntannnangnaaatannnannnnnanatttnttnnnannnnnnnnnnaannntnnntntnaaaannggngngnanannannacnnannntnanatnnnaananannnnnnnnannntanngaggngannnnnnananaanngannnanaannnnnannancanaatnnnnaanantnnnngnanaanaantaanannnacnaatcanaannnaanannnannnaannnannaataanncaaaaaaaaagccananntatannaaaacntcaatanncgtanaanaagaanatnacnnatannaananaanactaccaaaactnaanannnnaatncatatcnaanataactannaanngaatnatanancaganaannnagnannaatnntannannaaagcannnngnnaanacntcaagcntagantanntacaaatacnnnaaatantaacnnnanananaaaanaannnnnnnaacatncnaagannnnanaacaaanaanngnacaannantaacnannananaaananatataaacannaananannnaataaataaantatanataangngntcanatatnnaagacaancnaantaaacntnnancatnancgaactataaatagaannganatatganataanatnanntanaacncnatatatancnagtanatntnanancactananatacnannanaaantcntactanacannaacanctnnaactnanannantannnagnaacacncatanancgannnaatancnctnaanntnnannactctgaanaaannacanataaataactatanangctagnnacantncacntagtannnaatatntananattcnctanatananntntanatcactacgnactcanacatanaaannaagtcttanaganaaatatcactcaanaannnangggncactatntanncatnanncanaatannncancatatannacanataaantnnanatcnnaangatnaaatntnanangacnanacanatangtntatnnctaanctgtaaatacancacgaa

SEQ ID NO: 4660 - DNA, 1235 bp, Homo sapiens
  misc_feature (1)...(1235): n = A,T,C or G
gtttgaaatncctttggnatttctaatgcttgntnancgncattnatatntgnngantngnttggaantnngnacgangatntnntaaagcatgtttanaagtnattanaatggacggtttgncnnntaangattgggnataantggtggnaanantggantganttngtattgnttngatttgagttatctnattgaganctntannnnataaggagagttntattntnataaagntantagnanntannggatccttatntatcttngnnatgtnttaaannganataatantntttnnaattttacnattntaganattnatnggtgaaactttatcatatgntnnaaattnntannttnnnaatctntgcaaaaaattantagntttantntatncatntcnantttttntatttnttnctnntnattannnttantntgatntatgnanttcntaatttcntttatnatcnctnttactnatataattttnanntanaaanaagtaatnnannatntttgaatatatntntatcanaatatgnganattataatcatttatnttnnatagtatanntnatgnatgtagatatatatctatagntgntntnntattntttngatctgtatagncatcngnactaatatantttgtgatanagctattatggggantatntaaaactattgatgtnaaaaaaacatanntttataagantatanncnnnacgttataatagntctctgtacctattangcnattngattanaanattnntcnngatacctatntgtatnncatnacatattatatnggnganttatttnnttgtatataggattactatnttatgatanannntctttntataatnaaatatnatantgagggtntnctttntacagttgtanntnaaatatnagcgntnttaataanatagagngatatatgacattnatttatatatattaagantgtaagattnnatnaagnagtaatatcannatatagtatcnatnantgtcttncatggatgntatggatacttagtgntngtgaantttatnnttatatatanntntnattngtaaaatatactatantntatatatctgatatatataangaatgnatctatnatnnacnntataatatcntgtacgattaaaanattnaatatatgtntatatntgaatatgtataannaanctactgtctattgntacagan

SEQ ID NO: 4661 - DNA, 1235 bp, Homo sapiens; identical to SEQ ID NO: 4660
  misc_feature (1)...(1235): n = A,T,C or G

SEQ ID NO: 4662 - DNA, 750 bp, Homo sapiens
  misc_feature (1)...(750): n = A,T,C or G
tntaatttnatnctntannccnttcaactncttgttctttttgcaggatcccatcgattcgaattcggcacgagatgagcccatgaacttccccagaaactcattgtcttctatttccgtaacagctcctaaccactagtcgggctttgcacacagcgacttctccgtaaatgttgactgcagggcagaaagaaaggctaaaagttcttaggagaatgtttgcctttgcatgtatatgctggcgatgctaataagtcccagctagacctggcagtgagtaagttcaggggtggcaatttaattttcttgctattagtaaaacaaacagtaggtgggatgggtggtaagcttaaatatctctgacgcgccatttaaaccatccatcccacctgtgggttgtctgcacctgctcttttgttgcggtgggtctcctaatttgcttttcagtccctttcatcttatcattgttctcaaaggcaccgctctgcaaaccacataaaggcctttcaacttncgctgcattttgttttattcagccaattgactagtactgtcagctaattggattggaaatgtaaaatgaaagctgtattattcaactgccaacctcctcacttggcanggagtgggtgatgctggtaattgaccanaagtgtaattgctctgggtctgcctctggatttaacaatgaaccctgggagggctttctntganacacttgatacctgcttttttttttttcccnggggn

SEQ ID NO: 4663 - DNA, 808 bp, Homo sapiens
  misc_feature (1)...(808): n = A,T,C or G
gttnnnnntttgaatcccttngctctngnctttttgcaggatcccatcgattcgcactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttggctagagtttccactatcccaataaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgntgttccattttatgcagaagcatattttgctggtttgaaagattatgatgcatacagttttctagcaattttctttggttctttttacagcattgnctttgctggactcttgctgatggctgctagattttaatttatttggttccctacttgataatattaagggattctggatttcaggttttcatttggtttgcttttggttttttcctcatgtaaccattgggggaanggatncaaggaatttgacacaaanggngggaataaaacattaattttgngcccnnnnnaaaanannnnnnnnnnnnnnnnnnnnnnnnnnnnnnnnnnnnnnnnaaacctcggnccttntaaa

SEQ ID NO: 4664 - DNA, 1008 bp, Homo sapiens
  misc_feature (1)...(1008): n = A,T,C or G
ccgcncncnncnnngnnnnnnannnnnnngnnnngnnnntttnnttttcnannccnttcagcnccttgttcatgatgcaggatcccatcgattcgaacnngcacgngtctatcnctnngtgaagcactaccccngntacgggttncaccatgcctgggcagntnggccatgggcccggtcacgaacanaacgggcctggacgcctcgcccctggccgcagatacctnctactaccagggggngnactcccggcccattatgaactcctcttaagaagacgacggcttcaggcccggctaactctggcaccccggatcnaggacanntgangancaagngggggtcganacntnngggagacggagttgcatagacgcanggggagaagaaattcataacnccccggnccnaacaccncnaaggacagcagtcgttttnaccccgntgcancccgttctcggtccnaacagagggccaccacagnatncnccacanttctatattanggaggaanancggggaaagaatgtanaattttgaanaataancctactggtggtccaaanaactgnngccgacncncttgcntngtgnnaaagcgnccntggcangattnctngaaatttnntttggttggttgggnaggnnccccccntcccatttgccncgnccggttggcaaggggaaatttcctttcctttcaccctcantatnaaaaggttttncctgggagntngaactttcggggggttaaaaaancccattgtgggngcccaataaanccangacnccncttagggggggaagncccntnccgggnganntncgtgtccanaacgngngggncngtatctttngtggggncttntttcnaaccnattttggggggaggangcngggnntaacccttggcaaccncccggaaacatngggtgatgtgnnaaaacatttncggatgcanaatattttggcncccggggggngccnnantatatttgnggannagcc

SEQ ID NO: 4665 - DNA, 1690 bp, Homo sapiens
  misc_feature (1)...(1690): n = A,T,C or G
ccnccnnannacnnngcnnnnnaaannnaannncnnnannnngaaacnnnnnannnnnnanngcagngnnngnannnangcgagnnancngaanangacgcannnnannnnngaangannnnnncncgnggngncntgnanannnacaanaggcngnanacacnnngnnganannggcncannnacacgnananannnaccanaacannncngctancannaagannncacnnnanagcannncncagngngnggganccgagngcgngacntnnnccnattttttgggaaaccgggttttgggccaaaaacgngcttggggnagannctcacaaacgcacnnaggagacgagagagngnagccgngncnacgntnnaccagctacagcgaantcncnngnncgccnagnngnaanacgagacnnnagnagnnacnaccaanannaccangggaaggggggggaaccnnncgnccaanagnccnnacacnnantaaananngagngnngtaagacanccangnnncaaantgnnaannnnanncaanacnaaaanaanccnnnnacctatacnnagncacaacaactnanancnnagaanannannntntcnannnnaancaaaaaagaatcnncanntanannagnancganncgcgcananccncaangtannaannatantannacacgacgganacatngnanacnangcgnananacangnnnancncancananancnangaagatntntncgagaacgcgctgcngnatacacancngctnnngacngnnnaacnccagnannangcntnangacncacnnnacacacncgcnannncancngcacagcgnngatanacgaacgnnncaagctcnagnaanacaggtangccacangnagagnanaccnnnnacnagnnaaanaagncacatcaccgatanatnctcgannncnaccagcnnnnnncnagngacnncaccgcnnnnanctctnncnacangnnnangnaccnnngcntncacacgnanaanaatctncncccagaagcncggcncncgncacganacgcagagnaccgncagnatnantnacgcgcaaanagcgacanaangcangnccaagatanagnnganagcgnnatannagcacgtcnacacagcganacnngaagancacgngnanntnntnaganacannnngnaanacagcctntgacgnaacacagcannacatcnnacagctcngacancacganananggacagncncnganacacgngaacnacncaannncacannagangagancannctnannnagatgananctancanncacgngatnncactatatngannangnncgntgccgnngnnancagcagccngcaccancncctacttgcntactnnatncnatgagcaccaacganataagannaccacnccctnnancgannanatgaacacatncanntaaanngnagantnantanacgacnnncncannnacngangtacagnnnnntcaccanngncgnnngatangctcnnntatactaacnnanananagnnnnaacaacagaaanaancacnagacagagaagcnnncncatgatnncccactcacgancnnnngagtcngcngannntccnnnnctnatcnncagaantncntnncn

SEQ ID NO: 4666 - DNA, 839 bp, Homo sapiens
  misc_feature (1)...(839): n = A,T,C or G
tttgaaaacctttnatacaagctacttgttctttttgcaggatcccatcgattcgaattcggcacgagggnangganncnncangatcttgganggntcncnctggncgagaccaaggaaaagcntcggncgatnggngncccaatgcanggtgatggggatggcttnnannctantgntgnnccnatatccannatnangctggtgcataangnantcnnnnnccctaannncgcngaannntggncngatnttgntcnngacnntgtgnnnttnnatgtnnacactgtnnttnnnaacnntgttcgnnccnncnangctgatnntgacctggncaatgacctgctgtggnantgctggnttcactgntcangtgactatattnatccatacannaccaattnaccttgctcatatcatccntagnnttgnattgccactcgngattnnattgcantncaangcnnanctttaactannngggatnataaatnntccgcccntttnttgnnanaaaaatcttgnaaaggaanagcccnttacacttgtaaggaaattnnggccccaacctnagcaaatggcatanaaaaggttggcnggncangtccnatanaaancttnnangannattgtcaaaacanntnnacctttctggncatgaatcattggntgttgnttntagactnccaagagtntggggnggntntttttcaaaaannttttananagaacntttgcncggaactgttcagngggcaatcaactttttcncggnaaggctttagactgctaaaatggantttnttnccttataactgccancccaaatctttatncct

SEQ ID NO: 4667 - DNA, 848 bp, Homo sapiens
  misc_feature (1)...(848): n = A,T,C or G
gnnnnnnnnnnttntnaatatacagctcttgttctttttgcaggacccatcgattcgctcangcnggngcctccttccccagntttgntgcctgagtggaaccagtgcnnacncacagnccggaaaaggcgcatctaacgcntnttnaggctnnggtaactgcggacaagttgctttnacctgatttgatgatacatntcattaaggttccagttataaatattttgctaatatttattaagngactatatgaatgcanctncattnaccagtaacttatnttaaatatgcctagtaacacatatgtngnataatntctagaaacaaacatntaataagnatataatccngtgaaaatntgaggcttgataatattaggtagtgacaatgaagcatggnagaagctgtnacagattacatanagaataatgaggagattatgatggaaccttaatatataatgttgncagcgattntagttnaatattcgatactgnnatctatctgctgtatatggaatacttttaattcaaacgctgaanacgaatcagcatttagtcttgccaggnacacccaataatcagncatgtgtaatatncacaagttcgtntctgttttgggttatnttgatggtnggtttgtgnttttgctttaagttgcatgagctttntgcnggaaatantcactcatcccactccagataaggggnttagtcatnagaaagtctgtctggntgatgatggatacggggccaatctttntcccctttctggttaatagtcattacatttctatgccnnnnnaggancnnatccataactttancttaangtncacattggnatttt

SEQ ID NO: 4668 - DNA, 1690 bp, Homo sapiens; identical to SEQ ID NO: 4665
  misc_feature (1)...(1690): n = A,T,C or G

SEQ ID NO: 4669 - DNA, 780 bp, Homo sapiens
  misc_feature (1)...(780): n = A,T,C or G
ttttcatacagctcttgttctttttgcaggatccctcgattcgaattcggcacgaggtgaggctctcttaaaaaatttaaaaatactgaagaaacaaagggaggagtttgtagaatctggagtggaggaaacttctgtgtcaccaaacacagaaaccatcaaagaaaatctttcacttccaaaattagtctatagaaaaaaaaaagaaaatcttaacccaaataagagactgaggcaagagcttcaatcaatcgaggtttactgagccagagttggagcgtgccaggaaagcaacacaagtcaaagaaacgtctgtggcctgtgctctcccaagaagttttcaggaggctcaatatttgtacatttctttaaaggggagaagacagtgaggcaaatggttatgtttttgtgagactcttaattagtgtcccgtaaatctaagctatatggaagatagggtgaacactggaagaacagggagtaacagaagaccaattatgcagaggtctcaggttaggtggaggaatgattgatctcatcttatccttgtctgcacctgggcagatnaactttgtaattgacattgtcagtgtgaaatttacaagacttttggttttaggagttaggtttaggttgccagacctaaagttgcagttgacatgtncttgttttataggaggatntccatnctgaaagtttagggactggccaanaattactggtgagcaatttgtgantgcggcnctggagatcatgangctttttgcctttttgngggat

SEQ ID NO: 4670 - DNA, 712 bp, Homo sapiens
gttttagagcagctcttgttctttttgcaggatccctcgattcgaattcggcacgaggaactagtctcgagtttttttttttttttttttatgatattacaccataggttttattaacgataaatgtttgcattacttttaaaagcttagctcttactaagcattctttaacaaaagctaataagcaagaaatcatttgccatacggaaactatattcacaaacaagactttaatccaatattgaaagctaaagaattagaaaaaatacaaaacactgctatgagtcaattgaactgctatcattgaatttgctgcatttagaatgacataaacatactgaacataaaaacaattttatggatttattctataagactagcattaagaatgacatacaatttgtgatttcctttaaaaataattttttacaacagaatccatttgaacaaagggtctttttttcccctcatttgaggggaagacaatctatgtttcccaaacagatcctcctttcatactaaaatagcaaactgtggcctcgatctcctcttcccagatgctacttatagatgactttgcataataacttaattagaattacttttctggtaacagtgtcacggccataaataatcagtttttaaaaaacaaacatcaagggcaaatctagaaaacttcctttaaaggaattacccaaacccagcacacatg

SEQ ID NO: 4671 - DNA, 782 bp, Homo sapiens
  misc_feature (1)...(782): n = A,T,C or G
gtnccctntaaaaccttttttanaatctncttgttctttttgcaggatcccatcgattcgttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggtccagaacactggcaagggatgggaacctaacttcttctgtgcttctgatttgcccttgcaggtgtttttccaggtctgaccacctggccctgcacatgaagaggcacctctgagggagcagagaggtggatcctgtaggctaaaaggcttccaggctgagagcccggcccgtggaaggagggatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccccttgagactttcatatagaccttgcacaacaattgtatagatcacacaccggcttgtatttaatatgtaacattttcncacatnttaaagatccagaagttttaaaaaacccccaatgttaatgtatttgc

SEQ ID NO: 4672 - DNA, 782 bp, Homo sapiens
  misc_feature (1)...(782): n = A,T,C or G
gagccnttgaancctatntacaatctacttgctctttttgcaggatcccatcgattcgaattcggcacgagaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcattctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcngcctgcgggccacctcctcttccttggctcctgctttctttttagactatatcaacctacaactttactcgggaagagggacaggggtggacctgagtttcgtctcctgtctctctggctgatgtcacctggaataaagccttcttncctggccaaanaaaaanaccnnnnnnanaanntacttcnagcctctanaactatagtgagtcgtattacgtnnaanccaacttgaataaganacattgatgaattttggancaanccncaactntgaatgct

SEQ ID NO: 4673 - DNA, 706 bp, Homo sapiens
  misc_feature (1)...(706): n = A,T,C or G
gnttnagancaggctctgttctttttgcaggatccatcgattcggtttcggcanctggggtnggnactgttgataggangatgtnttaaggaaatgctaaaattgggcaccctgcccccaacttcaaagccncagctgttatgccanatggtcanntnaaagatatnaccctgtctgactacaaaggaaaatntgttgngnncttcntttaccctcttgacttnacctttgtgtgccccacggagatcattgntntcagtgatagggcngaanaatntaanaaactcaactgccaagngatnggagcttctgtggattctcacttgtgtcatctagcatgggtcantacacctaagaagcaaggaggactgggacccatgaacattcctttggtntcagacccgaagcgcaccattgctcangattatggggtcttaaaggctgatgaaggcatctcgttcaggggcctttttatcattgatgataagggtattcttcggcagatcactgnaaatgacctccctgttggccgctctgtggatganactttgagactagttcaggccttccaggcactgacnaacatggggaagtgtgcccagctggctggaaacctggcagtgatccatnaagcctgatgtccaaannagcaaagaatatttntccaagcngaagtnagcgctgggctggtttantgccaggctgc

SEQ ID NO: 4674 - DNA, 710 bp, Homo sapiens
  misc_feature (1)...(710): n = A,T,C or G
gtttaatcagctcttgttctttttgcaggatccctcgattcgaattcggcacgagtattggtttgtagaaatgctactgatttttgtacgttaatttttgtatcctgaaactntactaacgtcatttatcaggtcttttggagggattgttagggtttttttaggtttagaatcatattgtgagtgaacagagataatttgacttcctctttttctatttagatgccttttgtttctttttcttgcccgattgctctgggtaggacttcagtactatgttgaatagaggtggtgagagtgggcatccttgtcttgttcttaggggggatgctttcacctttgcccattcagtatgatattggctgtgggtttgtcatagatggctcttattattttgagaggtatgttccttcattgcctagtttgttgaggatttttatcatgaagggatattggactttatcaaatgcttttctacatgtattgagatgatcatatggtttttgtttttaattctgtttatgtgctaaaactattccccaaaatcaaagagaaaggatttctccttaacacattctacgaaaccagtatcatcctgatccaaaatctggcaaggacaccaacancanaaaanaaaaaaaaaaaactnggcctttaaaaactttnggggngccnnnttncgnaanatccnnnncttgatnagatccntn

SEQ ID NO: 4675 - DNA, 782 bp, Homo sapiens
  misc_feature (1)...(782): n = A,T,C or G
tttgaaancttttatacanctacttgttctttttgcaggatcccatcgattcgaattcggcacgaggtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccacccctgnccangccactgtgatggtgggtgctgctgaacccccggggcagcaggagccaggcangtgatgtctttgtctcggctcccacagnagaaccaggtgagggggcgcctgccaaggccanaaccatgtggggcaaactgaaccctgttccnctgtggcggcatgccccgatcttttacacactggtgaccctnanaaaagatgtaagatgnaacctggccggggtttnttnancccgacttttaanttgnccntncaaacctttggcttgaacttgggtctgtttacctaanaaagtcccacaaggtgccttattnntngggntttntttnnanaancnccnttnnnnngnnannnttttttnnatttnnnnnaaaanatnnnaaannngnnttt

SEQ ID NO: 4676 - DNA, 808 bp, Homo sapiens; identical to SEQ ID NO: 4663
  misc_feature (1)...(808): n = A,T,C or G

SEQ ID NO: 4677 - DNA, 708 bp, Homo sapiens
  misc_feature (1)...(708): n = A,T,C or G
gntctcatnntgnnaggctcttgttctttttgcaggatcccatcgattcgaattcggcacgaggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcanaggtacttgaactggcaggaaatgcatcaaaagacttaaaggtaaagcgtattacccctcgtcacttgcaacttgctattcgtggagatgaagaattggattctctcatcaaggctacaattgctggtggtggngtcattccacacatccacaaatctctgattgggaagaaaggacaacagaagactgtctaaaggatgcctggattccttgttatctcangactctaaatactctaacagctgccagtgttggtgattccagtggactgtatctctgtgaaaaacacaattttgccttttttgtaattctatttgacaagtttggaagttaattagctttccaccaaccaaatttctgct

SEQ ID NO: 4678 - DNA, 808 bp, Homo sapiens; identical to SEQ ID NO: 4663
  misc_feature (1)...(808): n = A,T,C or G

SEQ ID NO: 4679 - DNA, 880 bp, Homo sapiens
  misc_feature (1)...(880): n = A,T,C or G
ttatntttcattcanctcttgttctttttgcaggatccctcgattcgaattcggcacgagtcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcangcccggctaactctggcaccccngatcnaggacaagtggagagcaagtgggggtcgagactttggggagacggtgttgcatagacccaagggagaagaaatccataacacccccaccccaacacccncaagacagcagtcttnttacccgctgcanccgttccgtcccaaacagagggccacacagataccccacgttctatataaggaggaaaacgggaaagaatataaagttaaaaaaaagcctccggtttncactactgngtagactcctgcttcttcaagcacctgcagattctgatttttttgntggtggtgntctcctccattgcttgttgntgcaggggaagtctttactttaaaaaaaaaaaaaaattttgtggagttggacttcgggggtnaaaaacccatgtttgtttttnaacaagnaancaagaaggggttggtacttatttggnnttaaaaaaaaaaaaaaaaaaaaaaaaaaacntttgnngncccttnttaaaaaactttttttgnnggaggttcggtnattttaccgttaaaaattccccccacccttgggtttanggaattnncantttggattgnaaatttttgggnaccnaaancccncccaacctttgggaaa

SEQ ID NO: 4680 - DNA, 880 bp, Homo sapiens; identical to SEQ ID NO: 4679
  misc_feature (1)...(880): n = A,T,C or G

SEQ ID NO: 4681 - DNA, 880 bp, Homo sapiens; identical to SEQ ID NO: 4679
  misc_feature (1)...(880): n = A,T,C or G

SEQ ID NO: 4682 - DNA, 1690 bp, Homo sapiens; identical to SEQ ID NO: 4665
  misc_feature (1)...(1690): n = A,T,C or G

SEQ ID NO: 4683 - DNA, 933 bp, Homo sapiens
  misc_feature (1)...(933): n = A,T,C or G
gagnagggngttctaatnctggctntcagcccaanaacagctctgttcttgcncangatccgntcgatgttctccantggaccatccagcctttttccnagccaggaaagcccggntngagcanntgatatccangaatgngngaggctgncgnngcaaggancacctnaggtcngganatctnanancatcntggcnncatnntgaaaccctntngnnactatgnannntcncaaatcagctnngnnnnctggngnacgcntgnagtgccagcnccanggaggntgatgcagctgaacccctgancgccggnatggtcaagattgcnntgacgntnanatcnaaccattggnactccatcctggggcangangaacnananctntgactcacggtaatgtaatcnnnaggtggntggataaacttgaggataaaggnttcgannatcaanactggaggcaactttnncnggntaaccctatntantanctanaatatatntggaaatcnnnnacanggcaatnggctanancncnanncccttggtaanacacccntanttccntaggggcacgcgtnnacggcangnntnantcnncntaanaaacccancgtanggtgntaagggnttaccanntantcncgaanaatcnacgcccacctngnattttcctnnggcncttggggcaancaaaaatgnntgaaaaacntcttgngagntccaatanancccacnanatttcnnaactatntaagcacgcnntaannttggnaaaaacnccnaattnggnaatcantattanggangggggacatccatttttaaaccnttnganaatnnncccnaaaacnnatgctnttctannnggaagnnccaatnnggcataacnaaannntttngnngnnanncananatccnntctctnnntcnnc

SEQ ID NO: 4684 - DNA, 1383 bp, Homo sapiens
  misc_feature (1)...(1383): n = A,T,C or G
cccnnncnnnnnncnacccnanccccnnnnnnacnancccnanacngcnaanaannanctnnccnannancnnanangnnncncaannncaanccncnnaanacnanncnnananncnncanancnnacannnannannannannncnnncntcnanaaacacngacnnnnnnnnnnangnnnnaangnaggggnnncnnnnnnnnccnnngagganncnnnngggnaggannnggccccgttttttcctgaaaanagnccttggggnnaacagggcnanacantcancaaggagaganaggcnannanagggccttttnnaacangccannccacanangaacnncnnnaattcnggaaaatangcgcacnaaccaggcanacnactccngcgcacgatcnccaaancnntggggaancacatcnncnacaacnancntnnncccnanaagcctnangnccacnacnaacccccnncaancganaacacancccctanaaccnaacncaaanacanacccacncnnangacaacngnncanncnagcaccancnatncnnnnccggaccantnncngcanaccaaagnacaccagcnanancgnnancccaaacacacagataaacncnnanagnntccatngcataancggaanngncaccatnctncnaancaaannnncccntnnanccananancacttancantaacacccancnggtncgacnacaacngcanngcnactacatcncaaacacagccaacncgacncaaaaccacnacacagcccgcgccaaacccttaaccctncaanaccattancnagacctaacncnaacanncngnacggncaccannnncacnccnatagacccnagnncnncanaccggagnaaaacnntcnggnntanananaacaancaccaacnataangcaacngcnnagnacccnaccacatnncccnctcanannnacccnnacacgcgaancaccgagcaacannctgggcnaatacnctgcacaccnnccgccatagcgacaaanacnttcgcanngnnnnaaancannncgagcanccccgncctnnnaacacaaatngcnaannccagagcaaccacacancaggatcaacaacacatanngggnancngcnanagagggcaaanngncacaaaaccnaaaacatactctnnaaacacacaaaggccnccgacaaaanntnncacnnncananacncatcggacaccaccannaanaaccnnngggacgcgcnccantnnttccanananagnannnacccncccattacgagcgataancctcaaaaaacnnggaacantaccccgaacggccccactcantntnngnggatcaacgc

SEQ ID NO: 4685 - DNA, 773 bp, Homo sapiens
  misc_feature (1)...(773): n = A,T,C or G
ctaatcnaanncnnngcntntcgnnctnnccgaaanaaanaggctnnngcgtggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttcnctttgctgntctcctacatttcaagcatatctacctctatgtaagcaccagcttatggngtatatctgctgcgatcctactggttcactgcaagtaaaccagccttttgtctgtgggaaaaat

SEQ ID NO: 4686 - DNA, 784 bp, Homo sapiens
  misc_feature (1)...(784): n = A,T,C or G
gntntttntaagcgannngctacttgctctttgcgcgagnccntatnttcnaattcggcacgaggnngtctcctgagccagagtgtgctcagacagcagtccagctggtggaaagggacttatggagagaaaaagaaaagcgatgtagaaaaattgaaaagaggtacaganacagctggattggttacagctcggtgtttgccttattttgaacagggtttgaacagttggccacctttggttgctcaaaacttggtgattggcacangagtangttacagtctgtttgcacatccntttaggttgcngttcactgtgtacagagaaacctttaggctgaacttaaaacgngtnaggagacagctttctgcttgatttaacagtatcacgggtgtgtgttgngaggtanggaggtgggggcncttnantncngtctnctangnntgtgtcaacntctggtgcagtatctgtgcnnnttgnatctnctggaancnctnatctaacngacttggntaccangntnncnctttactnantgggtnnangggccacccttnntcttattnnggntggcanaancnttcccnttnggtnnctnggnaaactntttatgtggctctttgntgnnanaaganntggcttttttnggtntgnttaanggttnncnttttgnnaaanttgctcttttgtnnntntgtnnactaaaccccttttttntaacccttttanannngntnaaaacnnttttaatcnttccnatgnnnnnaannnttntngggtcnct

SEQ ID NO: 4687 - DNA, 751 bp, Homo sapiens
  misc_feature (1)...(751): n = A,T,C or G
ggtatagatcattctacttgttcnttctntatgcaggatcccatcgattngaattcggcacgagacccacttaggtggcnccaatgnngacntncaganngnacagtncnttnatnnatggggnngtganngcntntatatcataaatctcaagaggncctgaganantcttntgctggcanntcntgcanttgtngccattnaaaaccctgctgatncnagtgtnatntcctacgggaatactggccagaagggctgtgctnaagtacgctgctgccactgnagccactncaattgctggccncttnantcctggaacctttactaaccatatccaggnancntttcgngagccanggcttnttgnggttactgacccnatggntnancaccagcntctnactgangcatcttatnntaacctncctaccattgctctgtntaacacagattctcctctgngctatgtgnacatngtcatatccatgcaacagcancgggagctnactcagtgggtaangatgtggnggatgctnnctcggcaagttcttcncatgccgtggcancattttccatgaanacccttgggagggnaatgcctgatcttnnacttnnacanaaaatcnttgangnaaaattgcnaaatntantaaaccngnntntcttgnttgngaaangcnnatgaacncattggaanggaattttcanggnnttaantggggntttnnttanccctccnnnnanannnnng

SEQ ID NO: 4688 - DNA, 1383 bp, Homo sapiens; identical to SEQ ID NO: 4684
  misc_feature (1)...(1383): n = A,T,C or G

SEQ ID NO: 4689 - DNA, 763 bp, Homo sapiens
  misc_feature (1)...(763): n = A,T,C or G
ctngttcttttttcaggatcccatcgattcgaattcggcacgaggatcagatggtttaactnttgnggcagnngcgagaaanctntgatgatngangacanntttttaagaaagcaagaaanaaagatactatggggtcaagtgtaactccatggaaatgccacgtntgctcttcagtgaanaagctggntnanagtnncacngaaaacttttgactgtatntatttattgntgcaaaaaagacgcttttatattgcngccctcatttgtcacctaagnatnncttcttataaaatccagccccggatncatataancatctgtanctnatcatgattcctgntgnaaaagtcancnacgacctntagangncttttcttnctatgaaaggagctgctatgncacatgtgcacacnccgcacaactgggnatnaacaatgagtttattgnncntggtggaccaaaattaagcttgcntaagggttgngctaantggacctggactacagactctgacgccttgaatataacagtacaatttggcnatttctctgaancaggctaaactgagtaaaatctntttgaaggngtcctnggtgtgaacatttgccnngaagctaattagngnctntnngnatttnaaattcaacctntggngtggaatatgaaaccnanntnaaacggagataactttttctccccncanaaantnaacnttgngntccntaaaccnttttaggggatncnaaancnttnnnnccnc

SEQ ID NO: 4690 - DNA, 805 bp, Homo sapiens
  misc_feature (1)...(805): n = A,T,C or G
gnnnnnnntttgananccatcnntttaaatncattttgctactngttctttttgcaggatcccatcgattcgatcagtatgaactcttaaaacatgcagaagcaactctaggaagtgggaatctgagacaagctgttatgttgcctgagggagaggatctcaatgaatggattgctgngaacactgtggatttctttaaccagatcaacatgttatatggaactattacagaattctgcactgaagcaagctgtccagtcatgtntgcaggtccnagatatgaatatcactgggcagatggactaatattaaaaagccaatcaaatgttntgcaccaaaatacattgactatttgatgacttgggttcaagatcagcttgatgatgaaactctttttccttctaagatnggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgttttttntanaacacagttacccccttgcttcatctattgctagaactatctcattgctatctggtatagactagtggaacaaacttttaagaaaacagggataaaaaagaaacccattggctgtggctactgataaaaatatncccaan

SEQ ID NO: 4691 - DNA, 1197 bp, Homo sapiens
  misc_feature (1)...(1197): n = A,T,C or G
aggggtttacactnctaaaattnttgagctnncgntgggcgnaaagggggcncccttaaanaanttaaggcccncctnaaaaanaatcagggannattntgggggggctttgnggggggggtcatctatcnnnacaccntaantntattacncatagatactcaattnccntctctagnanatnnnnggatctttntcggctntnnanccnctcctactattactnctnaaacgtnccnncatantctntntacacatatatctnanatactatacatatantntcatantnntactactctnatntctcntctacatctctanttatnnntcnntcnctntctncnatctantctcatatctnnacgacnnactatttttnctccnnttcctnctntcncnntnttanccccnatnannatctntcaccntnnattttcnaatactctatctattanttaactatctnctntttcnnncnnntnnnnctatnnnncttctananactcntccnctnnnctnntnncnnntaantcnntncnntctctnntnnnnnntnntgnnnancctnactaanntcntcnncntcnntnattannanattnntacanntcntccctncanctnnnnnattntatantcttnttnccnnttcantntanatnttntnnctancnntcnntaattcaanattnatntcatcntcnnntnttnancaatnacaatnaccnccanntcacctaatnttnatcncatacnacnccnnnctntanccnnatatnactncnncanttcnntntnatctctnnttnacacactccnnngantatactnntnacacttcttatatnntntacntgtnatacactcttnacntanatatnnatcanactnatanaaagcatactatcatcttacctnctntnatataccatncaccaatcacttantntatncatctcannacanctccacatatnactcatcnctaatatgtctctataatnntncatctactcantcacnnnnactctntagatatatnctatactncancntatatntatcnattcatctacanantanctcncatctnttgnnctatacnataattgtntctcatatntntttctcctacannctttatctcgatnnttatcntgtancncnnntntatctanatatnacatatcacat

SEQ ID NO: 4692 - DNA, 1050 bp, Homo sapiens
  misc_feature (1)...(1050): n = A,T,C or G
nntnanccccnacngctttncntntccaatnnccctaaacanaaaggggctggggcnnagcnnagaacacatacaganananacancnaagngnctaggtttttcacctttttnacacnnaaancancacgnnccgagtnncgcagaaccngcgcnnncagcnncnnganncgcnnangnnccncganggctagagcccnnnnngnnagaggcancaacnaaccatcaccanngccaanncncatncnantcnganangaganagcaacaccctgnatncnaacaagaacccanaantanaanccannaagtnanaaannaganccatcanncgaanacccatntnaccnccccanagnncnnnnanctnanagnccagnaccnnacnnccaancccnnncgacnaaacnacccnctacanncgaatncgnaanntccangaccanctcanncntcntcnannngcnctcnnncanntnnacccnnaantgccanncnantccccanancnnccntnccaaacntnantcccacnccatagccanccaagaaccnncaaacnnctncgncanntcgatncncatcnccaccnctgcgnatacgnntnancacntcaccaancacgccaaaaccnnannnnnncanaccgacnggacancctcnctacgccnangnaatcnnccncccactcactcacctnnnctacntacatnagtnaaananccctcatctagaccagaacncncactatctacnactnannctnnanagacacagncacaatcntnanactnacacgatcncanacaccccaactcccncagcaaangctnncnatcancnactcatncnactctntactaaacgtcnnnntcacagngcgnaccanaannngcnatanacatncacnnaaanacgnaccnncgatntctncactannacncaagtntcnnntcnntnnncactcaancacnctangannnnatgcggtactcgnagaaatctcngcccatagncncacacannanccccctacgcacanntccnccc

SEQ ID NO: 4693 - DNA, 776 bp, Homo sapiens
  misc_feature (1)...(776): n = A,T,C or G
caaacngctggctacttgttctttttgcaggatcccatcgattcgaattcggcacgaggctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctccgaagaaatggaaatt

SEQ ID NO: 4694 - DNA, 768 bp, Homo sapiens
  misc_feature (1)...(768): n = A,T,C or G
ntncncatacagctacttgttctttttgcaggatcccatcgattcgaattcggcacgagcacattttcctgttttcttccaagccctccacagtgttccaacctctgccggttacccatttccaaagtcacttccacattttcgggtatccttatagcagcaccccactctaccagtaccaatttactgtattagtccattctcatgctgctataaagaactgctcaagactgggtaaattataaaggaaggaggtttaattgaccacagttctnagggttcgcaaggcctcangaaacctacaattatggtggaaggggaagcaaatgccctacttcacatggtggcaggaaggagaagaatgagaaccaaatgagggagangccccttataaaaccatcagatcttgtgagaacttactatcatgagaatagcatgggggaaactgccctgtgattcaattacttccactaggtcactcccaccatacatggagattataggaactacaatttacgatgagatttgggtgggaacacagccaaaccatatcaagtattaacagnagaattaaccangctgaggaangactctcagagctcaaagactggttnttcaaaatacagttnnnccaaaatnnaaaannaaaaaaaaactcggcctntaaaactatantgagtcgtattcgtagatccagacatgataagatacattgatgagtttggacaaaccacactagatgcagggaaaaaatgtttttttgtgaaa

SEQ ID NO: 4695 - DNA, 768 bp, Homo sapiens; identical to SEQ ID NO: 4694
  misc_feature (1)...(768): n = A,T,C or G

SEQ ID NO: 4696 - DNA, 764 bp, Homo sapiens
  misc_feature (1)...(764): n = A,T,C or G
ntantaaatcccttgctcttgttctttntgcaggatcccatcgattcgaatncggcacgaggacccggcggcgcggacaggcttgctgcttcctcctcctnngactcaccattncagancagaanntgaaaaaatggnnganctcacccaggtaanggatgatgaagtnttnatggctnntgcatactatgcannanttntncttntgnaaatgatgcntatgagtactgtaanngnnttctatncattgncaagaanggntnttgncaatncatangactgtgtagcattcggcanaggagaaaatgncaagaactatcttcgaacagatgacanagtgtaacgggtacgcagagnccacctgaatgaccttgaaaatatnattccattncttgnaattggcatnctgtattccttgagtggtcccgacccctctacagcnntcctgtactttagactatntgtcggagcncggntctaccacaccatgtgcatatttgacacccctttcnnatccaaatatagctatgactttttttngtaggatatggannactctttccatggcttacacgntgcngtaaagtaaattggccctgtgcagaaaaacattccactcagtnttccaantggcttnttaaggaattctngaccttgcaattnatantggagnnctttccttaagatttaaaggtttganggngagccnnaggaattntnaaccnggggtaaaccctttttggaattttnagcnttgncaanaa

SEQ ID NO: 4697 - DNA, 744 bp, Homo sapiens
  misc_feature (1)...(744): n = A,T,C or G
ttaantaannctntntcttgttctttttgcaggatcccatcgattcgaattcggcacgaggcggggcggcgcagcccgagctcccggacccggaagaagcgccatctcccgcctccaccatggagcccaccgcaccgtccctcaccgaggaggacctcactgaagtgaagaaggacgtgagtaacgcagctgtgcccagggcgggcgggggcgggctgcagcccagcgggagacgaaagcggaagcctggagtccgaggacaaggaggatcctccaggtcggaggagcggaaagtcctagcacaggaggactgtggcgagccctgcatccgagggaccttggtggcagtgatcctccagtgatctgtcaatccaggttttacatcgctaaacgcagagcttgggctttgttgccaagtggtgttttgattcttgcccactcctcacccatctcctcatgctttccccccaactgggttcttggagatgcttcgttagggactggcggctcagattcatccttaagtcaggctgcctaggctgctcactcagcctagagcgaagctgtaccaggtgaaggatcccaagcagtggaccaaaaatgtgaaactcttttgcataanggggcttgaggaagctcaacagctgaaagcacaacctggaattcccctagtnagcagacgcccacatatttaaattggggttgggggaatgaatacncgtactgagaataatgtncaggtaa

SEQ ID NO: 4698 - DNA, 1224 bp, Homo sapiens
  misc_feature (1)...(1224): n = A,T,C or G
gggttanccctttgnaactttgctaaatngcttggcaactcgaactcnctgcanggtnccatcgtttcgaatncggcncgagacgacacgcttctgcaggtgaanggcacgcggcgcccacggttncttnnagctgngncgtatgaagctggatggnngcnntgngganaangtagngcttgatntgctaataagaaatttcttggaaaagagactagctctcaacgcatccncnggngcggncggcttccnngcncncngacaannanctcgncaggngccngnatncggancantnctcncanaacaagggcgctggcgccaagaatagacaangngcggcatggccaacnaanacggtggcctncgnctggcaangaangtgaagaaggcngtcannncnaagnntanccaaantgncctatgnccnnaatgttgagctctntnaaaattcnntancttnttnnnantgnnnaantancncacancaggttttcattnnacncantantanntncttnnangancctnnncattagnccatnntcnttacattnaattccaatncngtnntggnttgnnccgccacttgcnttctntanncctgcnnncttccnncncgncantnnnngactgtnatcnttngtnnctactcttnntgcattncntncntatcaaccccaattgcccnntnnaattaancgcanttctcctcattcgncatnncctcnctantatttactcgnntctacnanttnacccaccgtntttannngctntnttntntaaacccnnctctnanctccnacatacgcnatnttttacacacctncttncttcnctcnggctatanngaccccntacattatctcatctcanctctnatacntgtcnccttatcngngntatnctnttctatcgcgncnnatcnnacggcctcacatnttnngnctcacncntnnatnnantctacacacttctcnntcatantgtctcaaaaactngnanctactcttnacttnnaganaattntatctnnccatactcatctnttcatagcgaatctntntacntctggtatccncnctctgttagntnggacacttcttctngtctctttnncntatnaaccgntatgtgnggtntattntcncaatncnctntntccanntttatcattnggtttccccctntngccnnatantgggngacacantngntnnt

SEQ ID NO: 4699 - DNA, 803 bp, Homo sapiens
  misc_feature (1)...(803): n = A,T,C or G
gnnnnnnnnnnttttgcanaccgctggctactngttctttttgcaggatcccatcgattcgaattcggcacgaggcaaccttcgcctcctgggttcaagtgattctcctccctcagcatcccaagtagctgggactacaggcacgtgccaccacacccagctaatttttgcatttttagtagaggcagggtttcatcatgttggccaggctggtctcaaactcctgatctcaagtaatctgcccactttggcctcccaaagtgctggcattacaggaatggagccaccgcgcccagcctgatttctttttttaggtcttgtcaggaaagatattgattcttttgattcgtgaacatggtttttggtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaagacctncagtatgatattgaataaaagtggtgagagaaaaacanannttatnntnnnnnnnntcnnnnnncnnncnntnnnctncnanccctcccnncnnncnnnnnnntccttacnnnnnncnnncccccttttaaanttnnnnn

SEQ ID NO: 4700 - DNA, 770 bp, Homo sapiens
  misc_feature (1)...(770): n = A,T,C or G
ggngnnnnncntttgaaatctntatacanctacttgttctttttgcaggatcccatcgattcgaattcggcacgaggttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaggctggaagatggccctaaattcttgaagtctggtgatgctgccattgttgatatggttcctggcaagcccatgtgtgttgagagcttctcagactatccacctttgggtcgctttgctgttcgtgatatgagacanacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaacctttagaaggaaaggagaatgttttgtggaccactttggttttcttttttgcgtgtggcagtttaagttattagttttaaaatcatnctttttaatggaacaacttgaccaaaaatttgtcacagaatttt

SEQ ID NO: 4701 - DNA, 756 bp, Homo sapiens
  misc_feature (1)...(756): n = A,T,C or G
ttncatcagctcttgttctttttgcaggatccctcgattcgaattcggcacgagggaggacgaggaggaggacgacgaagaggaggaggaggaaaaggaggtggaggagcagcagcagcagctgcagcagctaatatgttgtacttattctgtgctgggcaaaattctggatatttttcatgtactatttaagcctcacaaaaatcttatgatataggaaatgcttgtttccatttggcacatgaagaaactgaanaacagagaaatgtgaaacttgcgcagggtagtctgtccagagtctgtattttaactactgctgngttgcctcccattgcatagtgacttcacgtgtataggtggttttatcatgcgaggaaatatttgagtataaactgtatgtggtacaaatcattttttccaaatgggaatacagtgtgttccctaaaattaatgaatccaatataattccacctaanacaattactgagttttttctttgtggttgcagagcctaactcatcccatttccctccctgtcacttttcatttttaggatttgcatcttcatatttagtgaatctttgatctaatagntctggctatttaatagtagttttaaaacatctttagcaccgtcttggtanctttattcctttctttttacctagacagtttctcttaggacaaattctttttgttccacttctctttgatctgctatccacccatctcaaattatcaattttctttctgcac

SEQ ID NO: 4702 - DNA, 760 bp, Homo sapiens
  misc_feature (1)...(760): n = A,T,C or G
ttnnaannnntcangctacttgttctttttgcaggatcccatcgattcgaattcggcacgaggtgtcaaatttcttgtcactcttgctcaaaagtgtcctgcagctaaggagtncttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccctagaaggtttgggagctgtttggcagtgggagaactccggcatgtggatcaactgtcccgggagcctggtctatatgtggattcacatttctgtggagattttcngaaatgaacccgtggcagacttttttggttncacgaacntccagaatgagccttaaagctn

SEQ ID NO: 4703 - DNA, 805 bp, Homo sapiens; identical to SEQ ID NO: 4690
  misc_feature (1)...(805): n = A,T,C or G

SEQ ID NO: 4704 - DNA, 707 bp, Homo sapiens
  misc_feature (1)...(707): n = A,T,C or G
gttnagancagctcttgttctttttgcaggatccctcgattcgaattcggcacgagggctattaaaaatgtaatcagtgtgaaaattcatgccatctgaatcgtacgngtatgtaagggatttgagttccttacagaatnttctgtaatttannacttcaagtgacttataaatgtatatacttctctctcacaaangtgttaggagaaggaaaatctnaaatactngcttgatttcttaatttaataacataanacaattctcataacatgtatcacctaacatgtcactttcactttaaaagtctaaagagttgangtttatntcttttcttttaaagttgatgnttatgttggtgatttccnaaaagatcagatcccccgntatgaaggatcttaaccttgtcttttagatctccatgagaaatgcagtacatgtagcattagccatattncttttttagaggcctatgtaggatatttataacctgtaaaagtttgatgacttcatgctcaggagaaagcaagtaattacctagccaagccaggtgggtgttcaggttagtggtcaacagaaaggagatgttgaaagatttcatatctnaagggtaaaaacacaagagaagtatatagagataaacatgtaaagtntaagactgtaccatagtaagctaccttcgaagtggcacccttgttattatttttctg

SEQ ID NO: 4705 - DNA, 845 bp, Homo sapiens
  misc_feature (1)...(845): n = A,T,C or G
gngnngtnnnnnnttttcnaacgttgttaacatacagctacttgttctttttgcaggatcccatcgattcgaattcggcacgaggnnangcngttctgccnangangcatnctnccncnganatgccaccnnnntgcntgntnaccnnnacgnnncacacgnctacctgngggacatatacttcatgcacnggttatgnccntaccatgaanncctactgacancnnaacnngancngnntgttgannacatgaataacccactgnacnaagaacntantggaatgntanctnnntatgtccttnttccngnggaaggagnggacaacntttancaagtnncagntccaaancnaacnnanccaantatantnaaantnagngctgccantttngtggacnccttgcnanatnnnnanngctctctnnnaccgntngaaattttncataacaccatatgcnccatgattctcattgntgnaagacantcattcnatntaccagatnnatcttggnngcntntntncnngcatnngnnncactaaaaactgntntnctaactaaataggatttntntttnnttatacnngganaaaatgngagttgtgccnnaactntcatnngcgatanttacannaanttgtacttgntaaatctaagaatctaatgcnangacttaaaaaanangccnttagaactatagggagtcnanttacgtctatnccnacatgnattgatncattcacgacttngtccaaaccanatntntaattcctgaaantaaatgntntntttngnanaanntggaaaagcttcncaannttnntaancctaaaaccnggntnn

SEQ ID NO: 4706 - DNA, 775 bp, Homo sapiens
  misc_feature (1)...(775): n = A,T,C or G
gcaaccgntggctacttgttctttttgcaggatcccatcgattcgaattcggcacgaggcaaccttcgcctcctgggttcaagtgattctcctccctcagcatcccaagtagctgggactacaggcacgtgccaccacacccagctaatttttgcatttttagtagaggcagggtttcatcatgttggccaggctggtctcaaactcctgatctcaagtaatctgcccactttggcctcccaaagtgctggcattacaggaatggagccaccgcgcccagcctgatttctttttttaggtcttgtcaggaaagatattgattcttttgattcgtgaacatggtttttggtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaagacctccagtatgatattgaataaaagtggtgagagaaaacanannnnannnnnnnnnnnntnnnnnnnnnnnnnnnnantnnnnccnnnnnaantnnnnnnncnnnatncnnncnnnccncntttgnnantnt

SEQ ID NO: 4707 - DNA, 1102 bp, Homo sapiens
  misc_feature (1)...(1102): n = A,T,C or G
gggnttccccctnnnaacccnttggaaanccnctggngctncntgcaggatcccagcnatngcactgagcnntgnggccnacggcngagccntttttcngcgagacgngcccnncanggcnccggggngctcgtgctggnnagccnatgggnagcannnancncaancggcctnccnanaccagagnnncanaacgnaccnagnnngtgggcncnccctangtcnaggacanaatannnanncntancagctgntngggcncgcannaanggnanannnncaggcccncnaanntaagctncnngaancacncgntntatacncccnananaagnncncnngntaacaacgccaggcggagcnttcgngganananccacgagngncccgcctaaggaaatggncgccnanancagnaccccgaanaanagtantngnggtnnntaanccgagngaacgtgacaggcgnnacgcaccgacatngggcnaaanagaatcgcctnggngncacatcgngnnacnagnganaacgtncaacgnacanncgngcacccnntnnnacnngtcanacgaaacnncncncgcatntgagagcncggcgcnctcnctgcaaggggnngcttcnnnacccccgccnaaananttnnnagaaatcccnccnagacgtnttataccnnagacacnaccnngacccngcgnngcantagtcgnanagagaggctnggtnagnananncantgcgcncgnntcccnttcggcgcncnanaanaagcccagcgctntngaanngtggcnccccnntgngnncgcgcnagncacccnggtggcgaaaacacnggnangngccnntnnnaacncannggggggggcnanaacccggggggaaggcgtnaccngcanaanggngaaaacngcccacanttnnnctccgccnggcantanccccnngaacatcgnggngcannncccggcanngnccccggccaggcnggcgnnncccaggnannttacgnaccgganncccggnncnacnncnaggnncccnanacnnnggnaccnnngncnggngggnnacgatggggncnngcnngnnctgccanca

SEQ ID NO: 4708 - DNA, 855 bp, Homo sapiens
  misc_feature (1)...(855): n = A,T,C or G
ggtgcttccccctgngaaccctttntacaggcnacttgtantttntgcangatcccatcgactcnaattcggcacgagggcatancccggaatngngtttttgatgcatccagtcgtggcattgcaagaagtctgtctgatgaagctcgggaagcattttgcaatattcccttnggctgngttcctgtgttccctgctcccacttatcttcccctggtttgtgattattaggagagaggttntgcaaagactcnntgctgtgaaagaatcttttnttaattnttatcctanagtcantcacttttattccaggnagtcatgctgatctacttatccaaagccagcnaaccaggntcatcctaccatcctcatggaagactgtgtgtatgaattggagtaacagaactgaantacacttaancagtgacagcactacttcccagggtgggggccatatttctctgngtcctactctgagcaacttctcanagatacganggggctagggttttcccatntggggaaatggggtgaaagnctgcanatngntaaaagcaaatgttngaaccancaataaatnagatnnntcnncatngnncaatnnngcactantnacnnnnntnganannncgtanntnnnctncgncnnctnggnagtntcncnnggnnctctnnattcctcgnnannngatcngcaattggnannttcannatntggatnnacanctatncgtgancnaatnaacntacnntgngnngtacnacnacnntnactatcncatacgcgntcnaaaancgatntcacgtntncacnattngnanatatcannttnctctnncttgntctattnaccg

SEQ ID NO: 4709 - DNA, 843 bp, Homo sapiens
  misc_feature (1)...(843): n = A,T,C or G
tnnnnntttanttttaatatactncagctcttgttctttttgcaggatcccatcgattcgaattcggcacgaggaacattcggactcgagataatcgtcgccttggggagtgggacttgcctgagctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactggtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagcccgggcatggtggcacacgcctgtaatcccagcttcttaggaggctgaggcagganaaatcgctttgaacccnggaaggtagaaggttgcantgagcttgaaaattgcgcccacttgcaccccccttaggcgacaagaaccgaagaacttttgtctnttaaattaaattaanttaanttaanttaanttcccaacctggggnnaaaaaanannnnnnnnnnnnnnnnnnnnnnnnnnnncccttcganccttnttaaaaacttnttagnggaggtcggtntttaccgttaaaatccc

SEQ ID NO: 4710 - DNA, 1501 bp, Homo sapiens
  misc_feature (1)...(1501): n = A,T,C or G
nanggagcaaggccaggtttttnnncngnnctaannnanntnnagaaacnacggcttttgnggtttannggncnaaaaaacccccncaatgcaggcnccagcaganananaaggagncggcncggggaggnggnaananannnncatanaccngacgagagnggancacnnntaacagaagacacaccanaacacnngaacncancacaaagantcncanacctaannngcgacgaanacncnacacntntttttttttcacnaanaanacnnaaannagagngaacgcannannagnacacnnacnaccacgagggggagangnacnanagagnggacaacaagagaagaaanaacaanccaacacgcncngaacaacaacacccccngacancacaanaacacanancgcaccaaacaataanatcagaganacacacagaccaacanaacacncaacacnngcnaaaancnaacgaagnaaanncaaacaacnaaanccacaacgnagancannnacnacacaagnaaaaaaatnnannanaanancaaanncanaaaccnaaaaannncacananaacananaatncnnaancnaaccaancnacannannanaccncacagnantaanaaanaacngnnacanaannacacagagacanacacacnatacnnacaccanacaaaccaanancngacanactacnnaanannnnnancnaaacancgacanagnnanacaaacaaagnacacgnaancatncncacnanagcanannacgnataacaccgnangagaaagatacnnacatnaananctanaaacgcataccgngcgcgncatanaanagnacnnanananataatagcaaanaanacacnnaagcanaaacaacacangncaacaanaacaaaaaganagaatcncacagacagngcantnacgcacacaactagacacacaagnganacaacgacacaanatagataagananaganagnnnnagaaaacncacacganacncaacacgaannacaganannnaccacnnaacacaangagcaccnacancaacnanananancaccancnannannnaananangacacaaacacncnatacaaannnaagacnacnncacacanagatanaaanaanagncgaccgcagnnaaacaccacgacaggaacanaannncnnacnanananngaaanngtananngagggaagcaaangaaannaacacantangnnggaacacaaanaanancanannnccatnaaaganaannacannaacnccnganaaaaanggaaacacanaancanaccgnaanaanancnncnnananannacaaaancaccntagaancncanaanacngaacnaaacacaacnnnancanacaaccgaatnaaannnncancacaaatgnntnanaccaaaganaacnanancannncaaaacnacacncncgaaggntnnnaacnng

SEQ ID NO: 4711 - DNA, 806 bp, Homo sapiens
  misc_feature (1)...(806): n = A,T,C or G
tttttaaaacttttaagcccttgtgcannngcaggatcccatcgattcgaattcggcacgagaatagtagaaagggtccccattcctgctcagcacntttcctctctacccccccacagacacacatgctgacacacacatgcngacaacacncatacacacacatgcaggcactcacatgcaggcccatgcacacacacgtgcacacacatgcaganacatgnagacacgcaggcacacatgcacanatgcaaagacangcatgcangnacacgnagangcaacagagacanacatgcagattcacatgcacacacacatacacacactggnccctgtttttctgtggngtcactgggtgccagnaactctgtatattacacctancactaaaacctgggccttaatttctctcccgtccccacccctaaattcctgatggatgaacctaagaacttncctgtacacttcaagccggactgacgtagcctatgggcccaagnaggtccagngccnacgttttaatttctttntaaaaagctttaagtcttgctgggcgcggtggntcacgcctggagtnccantatttttgnggaggccaaagcngntggatnacaacgngcactggttcgngancancctgaacaacatgggggaaaaccctggtttntaattggaaatacaaaaaaaatnngcttgggccanggtgganaggcacnttgtgaactcaacctccaggttttttggggccanaaagcatacccccacnangcccaatttaatttnttaaagggaatccttggtag

SEQ ID NO: 4712 - DNA, 695 bp, Homo sapiens
  misc_feature (1)...(695): n = A,T,C or G
agattaaagaggaaagcagagactggttaggttattatagtgtcctaggtaacagttttggacaagtgtgataaatgttgaggtgggaggggttagaggttggattcagactctgttttgtaagtagagaagataatgtctgctgatagcttggatatgaggaggaaaaggagaggagtaaaggatgactcagatttttgacctgtcaattgggtgaactctgagattaaattctgttttggctatgttaggttggaaatgctgtgtaggcaattggatatccaagtctggacttcaagagtacaatttgggactagaaaattaatttgggagtcattagggaataaccatgactttggatgagatcacctagtacagctagagaagagaaggtagcaaaagacaganacctaaggtatgccagcattgangaagtanaggagaaganganccatccnnnngactgncaaggacccaccagttgaccttagaagaaaaatcaggagctggtattctggaaaccatcngaagaaaatgtttcacaaanagggaagtagtattgaatggtgtnaaatgttacctatattcctggnaaaaaaaccacttcanctgcttttttaagtaaatgttgatantttgtactgcaaatanctttccatantncttttcaaaacatgntattttnggncctttaa

SEQ ID NO: 4713 - DNA, 998 bp, Homo sapiens
  misc_feature (1)...(998): n = A,T,C or G
ggtgnttccccctgngaaacctttatacagcctacttgttctttttgcaggatcccatcgattcgaattcggcacgaggncacattcanntntcannttttgcancnttatancaanantcatngccganacattanntgnctnnaatagtactgcangcncancatctncnnnngatccctgtnaccttgnccctggancactcgtnagncaagntctgntcccagatgncntgtaaccatnantncnananaanannatcnagggnctntttntttccnncaaacagatgcnatntgncncnggctgntgtgntgtngagggcnctangcncnggcaactattnncttnnangcngaagtngttacncntnanggcncncttanctttcaatnagnaccacatgcnnctgccaaatngtgctctnagctaaatnnttggactntgaantanggnncnaanggtnttgcaataacantgtggatctgnaanaagnctgtttggnnngngacctaatnacctcancngggnggnctcnctcttaacnntttantnccnntcntnganagtgattcataccaaggtacccangnnnggtaatanttcnactcntgngatcgnaanttntnccnttnnatcncnttanagagnggtcgtnacccangtntgttcgcttcgcncttnttttggggngaaatgtatntccccatggaancnttgggggnnccnntttgatngccgtaatancatnggaagtcaacttgganttaaacgggtgctcanttannctnagccgaatntngtcnttggcaaacccttgccaatacnnccaattacccnatantngcaaagnaaataggccnngcataccnaagngggaccctttataaattggnnnatggacttccccttnnaagtngaacnttggncttagcnaaaaggcnatnttcttgtatgaagntcgcagnantngnatttattngggttctangggccng

SEQ ID NO: 4714 - DNA, 1523 bp, Homo sapiens
  misc_feature (1)...(1523): n = A,T,C or G
ccccccccccccnacnnnncacccannncnaccccnnacncanacnaatnnncgccncantcacncaccccgnntcganncncccccncctaaannccnancgcnctcnccnggntcgcannccaccnttgaacctttgcaaanactggcaaacccgccncnanagcggggggngganncacacncacnncanatactanncnncccacntncganaacganagnnnncccccccaacnactnaggggcacctcggggnccctcctcctacgcnacncnancacatnacnncctccngttcanncnngacagnancctctcacnccccacgcctgctncctctccncatacncnccccccctcccnatacgncncgacancccacgccnnnngnannctnnctcatcnnacncacngcnctacacnncccacnntncccttctnggcgcancannnncntncatcgccncagcncacnctctnnctcacccccatcatnacctnaanccgtctacntntnnnccnctcanctcacgcnctaaccgncannccncccgnnanactncacnctcaanncanatcganccccctcncaccncnaccnnnnnnncgnnccncccaccnnncaannncngtnnncccacctcgagaccnnncangcnaatacccccgatcanccaccnctctantncagncctncccgncnncncganncacacgangcccncacacnacagcgcantncgncaccncanacangacccanctgcccncagcgngnnnnggncanaaangnncngcncnccnctacantcntccacccancnnccntnancnccntantannaccaagccagtanncncacctcanctnncgaatcnccancacnccacanacgaccgcaccccccaacnncagcactctcacnacnnngancancannntccacnacactcnttctcnntactctntctcantcccccnnnctaacngctcactncacaancnancncncncnnanntagcctacgccaacganacgcacnctanancctacgacaccnntcacnacacctcaccgtaccccnccngntctncnctcnancgacngaancgtnncacgcncancacancactcgagnantcacacgnnacacctncacgantactccgncaccnnnnanntnacnccactngancgcatcntctcncctaacnacacnacntaccncacctcacnccatatccacnctcaccactcacacannaganaagnnnanaccgctctcagcacntactcactancnccncaacncncaccacancncanacgtnanaccnctcngcgnctcacannagcgnctgnnctgcnnnctcccgnatannntcgcaccntgancacncanacntntcccncngccccacgactgagcncncnntctcnagacnncanccactntcnacacnncnngacgcanctacngcnccancncannnctnanngacncacngtcccannccc

SEQ ID NO: 4715 - DNA, 726 bp, Homo sapiens
  misc_feature (1)...(726): n = A,T,C or G
gttatnancngctcttgttcntgctnctggatctttttgcaggatcccatcgattcgaatncngcncgagtntaggnntganccattgnacccagccnaggttnttaatannannnanagcntgctgntntnaaaagtgaaaagaggccagntgtggtggntactgnctgnggtcccagctnctccggaggctgaggcatgaggatcatttgngcccaggctgcaatgcaatggcactgatcacggctttctgcanccttaacntgctgggngggacacggagtaccctgtttttnaangaanantgcagagtacnccaattgnatatgntatataannncaactntcntaaagganctgtatatnnaatgagtggaancaaatntggcanacnnttaatngnacatatnttgaaactanagctcnttacacttctttganctacaacgggtatatgtcntacttanatgatgcacaaaaggtgcaccatatatatatatgtttntgacgnnggttntganagagtttcactcttgcncncannctggagaatgtacngaactganatnggngaaatgtctccancngggngatnnagatnnactgggctntcgtggaagaatggtgtntaccnnaaaatttggagcctctttaaacnantggngaggacntttacntnggttccccaaattgtngaggggncntttggngantttnnnccnnncc

SEQ ID NO: 4716 - DNA, 1554 bp, Homo sapiens
  misc_feature (1)...(1554): n = A,T,C or G
ccacccncnnntnnttnatnnnnccntncnacctcnnnnnnncnnnggnnnantngcnnnnnnnnnnaagnnnnctnatgaactnaataaganntngctggtctgaaatngcctaactngaatagggnctggggggggncnncngncnnaggntnatnncgtntccagtgntntngnnngntctcgganntnnntntaactatnnntnnnnanccannananngtcgngggntnnnnnatnttnnnnntnnatccannnancacanntccttctnntcantccnannaacctcntannnccantcccctatnntcgancagnnnnncccacngntnnnnnngtcnnnannnnnaancnannattcagctnnnacnntannntaacttnncccngcaangancnccnntctcctcngntcnaccggcnnngnantncnngntcancanntatntnnntnntnntctatcctnnnncntntctagannannnnnntnctacnnnntncaanncancnnnccatanantantccnnctcngnnctcnntcctcanncgngnactntncnngctncnnnntatctntnntcnacnncacncnatannnnntctnanantccnnnttcnacncnnnctnatcncnantgcctanncnnnnccnncnnnatgtnanncannatnctntanancngnngcnnnctnntcannnnncacnctnnatcacatntnnctntnnangannnntcnntntccnnancatcnatctncanctctncanntntncnntatccgcnnnnnancctntnntacnntccctncatanantanacnncnctntcctcannnncnnntnantcnntatncnnnannncnctnctctacacncgcnncngcntcnactnncncnctatcnnnnnaanntcncanctcatnacctcnctcntnntnnntncnatcncatntatanacnnanactctctntcgnctatnnnngncnntctncacagtatnccnctnntntncntannancgannctccncnnatataatcactnnacactntactcnnantncttactntnnaccnctctnncatccnnntcncctctnnnctcatatntgnntacnntnnancatctctcncancancnnantacacncnnnatncntannncanantnncntncannncntcnnctnntcngtnnnnctcncactctncacatatatnatctanctnacncacncctnnntnnnnnntnctcannnctcncnnntctatntgctatacatnnccctnntancantatccanngcccncacnatanctcanntatctcntnccttntancnccctncntcctcntcanacccancttactctcttantnncacnctntncntccnccnnnctntnatccnaacncnnnctanttncatccancnctccgtatanctcccntnncnncnngcccnccccntactnctctcanntgnncccntntnncatntcnctntcnnnccaccccttcncnncgnccnttnntnannccncct

SEQ ID NO: 4717 - DNA, 763 bp, Homo sapiens
  misc_feature (1)...(763): n = A,T,C or G
tttacatacagctcttgttctttttgcaggatccctcgattcgaattcggcacgaggtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcacggcaagcctgtcttgttgctgttganaatgcgtggcgcaaactcaagaagtctgtaccttgtggccaaaccttangaaaacctttctaatcaaagaagaagaacaaaagaatgggaaggccaatagatgatcaccagtcatccagactctnaagttcattactgtccacaaaaaatcaaaagtgcacaatacttctg

SEQ ID NO: 4718 - DNA, 953 bp, Homo sapiens
  misc_feature (1)...(953): n = A,T,C or G
nggtncaccgnaacaacgnngaatcccccaannncncganacagaaaggcaggggtgnggccngagagccgngcncacngggcacancagcgaccttttaggcnttnctgcactgncngncccactgccgnaannggcactnccccacgnacgagnntgcaacgagacatccgtacgtgctggacaaccttggagagaagccgtatncacnncacangataaaancgccatggaccacgagtgccnngggcactaccgangagccgcctccnggaancnttnccaagngngagcgcccnaccgacngtnngcngatcaganacnggagaggnggagngagaagactccngcngcncgggcccccctggggagcccccgntccagggctcgcnccaggaccngcngcacaagangactagctngcagcnaccngcnttccccagtccannctgaaaaactacaaaatnaaangcgggaaaagcnctgtanngagaanggncntccncgcanctccnaggaggnaaggcnggagannnccccgctcgnaaangnangnagcaagggaaanccccangggncgggcccncnagaaggccccncccnncaanaaagaangccacaacaanccaagangcnagcacgggcnngcccngcanaaaaccccccnnacacnggaaanacncccgcgnananngcaannaacngnatacnggaaangcanagngcncncananaacaagcgcncncccnnacnagggnnacacaaaannccngagcgcncncgagcgcgnnnanacacaangcnagcacagggacacncncagacgnaaannnggncacanacncgggnnagaacccancacgaaaccnacnacncacgagggagagngnacnaaanaanncgcccccacgnganannaaanccaacnnnncgaanacnnacggannacgcc

SEQ ID NO: 4719 - DNA, 860 bp, Homo sapiens
  misc_feature (1)...(860): n = A,T,C or G
ttnantnngtcattcctgtaccagctacttgttctttttgcaggatcccatcgattcgnngatatngnnngnctanncaaagtgggaanancttncnggctgngaaaacangctntangnccnaananccngntttacangtnnaanactntgtnnnntttgagcatgttnncnggtcttangnngntattnnanngtanccactttgnagaggngtatctggcaacttttcnncttatggttcaattagntccngnntgcacantgagnntgatnattacttgtgagntgagctcntgcgttttaccgacttctggctnggnactggtgccattagctatnaanaggcntttngtnncataannttcnggtaanntganngatctntnaagatncccctttaattcgttagtantaccattacgtagncnaatttangatncnnattcccnaattttnancatnnccanntgtaanatcnntgaattancagnacnnccnanngccctntnnaggnttgatttctcgatatttgactncntctggnngnananannggcnaagaanttnaccattggctangnnaaannagngtgntgttagggtnaaantcaccntntttttnnacnaatcnntggaacantttacnatcanttngnanaaaacnntannncttttgcccnatggganctntttnttaaanccnntncctttttntaacnnttttttnaacccntggaaaaaattngntaaataaaatntngccctttaaananttnttcgnaattnngaatatcttaanggcccttttaaaaatatggnccccgtttatggngaaaantnattgccagccantncnt

SEQ ID NO: 4720 - DNA, 714 bp, Homo sapiens
  misc_feature (1)...(714): n = A,T,C or G
ngtctnttaacgngctcttgtcnngctacttgttctttttgcaggatcccatcgattcggtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggcacagtgaacgtagtttacnatcttgaaatgaaacttanattttctggggaaatgttcanatcagttntgtgaactgtaaatnaaaataccttttctacagttatctttnattttctgcaaattangaacctnt

SEQ ID NO: 4721 - DNA, 868 bp, Homo sapiens
  misc_feature (1)...(868): n = A,T,C or G
tttcnngtttaaacncctttaaaaatntgnnacttngatnnagtntaaagtnncccctctatatattgnagtancncctntaaaacatcaggaaaattaaggnggtctntngggggggtgatnttcnatnncnantgaataatgatccaagnntcntantangaannaangcnctatatananntantantactntttggntnnnnanctantanantctannntactcnntanatantatcncnangtnngcatacnatntnatcnttnnntnntttactncattatctctanatattnnnncnttntnntntancatncntncnanctttcnnncttattnatantnntttaantttttcntntcncttcncnnnncattnataattnatnnnttnnnnnnntnanttctntcaatntntcatncctcnnnnctcnnanctntntncctnantnnntntccantttnccatttantnnctannnnntnnnctcntntntntttntnnctcctaancctctnttttnntctcanntnttnttcnncttntnntttatttntntcntcnnncnctcnnnctttncnncnntntctttcnatantntctnnccanntctncatatcttnntnncnccttaatnttacncttncccnctnccccctcnnancattttcnttctccttanantnnntncttnntnttaanatatnnnnntttatttnnacttntttgtttgtactnctnntnacncanantcaatnacacatttatcncattncanatctttcnaantcnctcnnattncacttnattcacnantctncaattcctacatnctntatnctnacntcatattnnctcccnnt

SEQ ID NO: 4722 - DNA, 1612 bp, Homo sapiens
  misc_feature (1)...(1612): n = A,T,C or G
gtnnctcaaatcngcagcacgnanagtncaaagngaagnggcnctctacatatgagaccctnaaacatcaganattagggggtctngggggggcctcnncanatncnngaatactatccgnggcccttttnngntnannnntagaganntgggnggnntnnncggngntntntctancnnattcnnctttcatctcctactcngggggnnnactnnnnactctctnacanccctncnttcnntcnnnncctacctccctntnncnntcccgnactnaacacnctntccnacnttncttncactcnatannccnccnacnctcttacnntnnccaccacgtatctcctnccnncnctctctnnaccnttannatnntnactcncncnctnncnttcctatanctcagcnnntcnactccgcccgtcantcngctacngtccnncnntctctnnnnangcttcctnnacttcncnntcancacaatntncctcatctnnccacttntntncnatatctctcancctctnacnntcnnnntcatcnnnacaaatntctncntccanatccatcttntnnnnannnaccatntnanntagntccnactactntcccacgtanacntntctntntcccncatctcacntnntctatnatactctncnctcctcacnctatnanatcnnatanctatcctatcactnttacnaannncctcacannctntccnntctctctctannaccttcacnnttcnttcnatattatntactnntnaccanatancacacnacnctccccncntatanntacacntncacncactanacnanctcncnctcatactctantntcctncnntcttatatcnntctatcatatantnacncaagtcnctctctcatntaccnnnantnctnncccactacnnctccnctanctacnatacatncacannnnanatcanataccnntctcnatncnctctcntctctntntntcacnctanattcnnatatnccnctatcnncttccnnnntgnctcctactnctncctccncctctctcntcactntctnanntanctnnntctnttncttctcctcncacngtaccnctcnatatcatntntcatcnctcntccatanatncgnnacancntatatctctcctntntnccctannatncatctnctccnntncnncatctcatannnccnnctgtcanacnnangctctctcnactntccanctcctcnnctcgcnacngactnnatcncnattcctctnttngactccncctantcatcnccccctacnaccaacaccannatactnntcnnntcncctctnaatntcacacacantncannncaccntancttatctcanttctgntnacncatcactactcttctcatctacacatnantnnancctnattncttctacnctctcnttctcncntnatnannctntacangnctctnccatntctcncccctcctnctntntnnntcancnntcacncnaccantcannnctanccgcatctatattatnctcatatcctctanacantatcctcanatctcactnctannnatancnacct

SEQ ID NO: 4723 - DNA, 1503 bp, Homo sapiens
  misc_feature (1)...(1503): n = A,T,C or G
ctaaaattgtctncgtaaatnctntnnnntgtacantaggaacggcnctgacatatgagacncttaaacatcnganatagggngtctngggggggcgcttgcntanccntgnanntgactnacgnnccanttgaantaannctttaanganattanggcnttttncgcgcntctcnctcaanctcnntattncantntaacanngngggngcntcntntcancatcnancncttnctacttcctttatnncttctnctcncttcnnactacttntactntnncntncaccnnaccancattnnantntncancctccntcntancnttcnctnnncncatccnttnnccncntcantcctctaacncnctannnctcctntntnccanattcatnccnttnnttnanccttntcntccttntctatcattctacnctatcctctcctaacnctttttnntcnnctcacnntcntcntacactcnnccancnacnnaaccaccntanncctctnncnttcctctntantacntntcnatcttccnnncanntnattctnacntantntntcattnacacnctcnncctanntatnntnttatctctancccctcantanatntcntccatnctcaactntctcacctctccctctanatccncctnttntagnnactcctctgttnnctgctantattncntatacntctccnntcntactntnttttatatntacanctcntcnnnctnncctcncntnnacncntnaataccctcatcttatatntnntntncnnctnntatcntnatcttanancctacantnttcntcataatcnnannncactctntanntgcacatntanactncccnncncanctctttatacctntnctatacntcacnntctntnantnactcnatnactnncatacactcanatncacctnntnnnatntcnccatatatntntantanctcntctctcnatattatatatntntctntctntncctnctcngnnctctnctntatcanactctctatncncaccaactatnnttcnanntncnnnctttcacnnnntnaccantcnttcnnancnctatcntctctcctatccacttnnatcntaactctctcatatacncnantcatntcnnntncnacnctcntntntctcncancctcttnnctactacnnttatctactcactctatntctctnnnctctacantctcnctntcgtntccacnttatctnnnnncactatctctntcactctnancntaaacctcctccttntncatntcacntctctatnccatttctcaatancactcncncacncattcctctntcncatctatctcttncccanctcntctntctcannnantngttnctctatcagnactcctatatantntatctcnatncttnatatcacanncatnnncttctcnnactcatatnntnctntantntactatcttnttcct

SEQ ID NO: 4724 - DNA, 1309 bp, Homo sapiens
  misc_feature (1)...(1309): n = A,T,C or G
cantggnaantntcccgacctangactaggtnnaccnnccangnggggaaaaaagccccccaganagnnngaggtttggagggngggaaaaaagannnccggggggaggggggggnnttggaaaannngganacgggggggcacgnnngcgngcgcacncntntttttttcncnccccgcnccnttnntttccccncnccgcncggagtgnncnngnagnggggggnggnnnnnaganaaganggggggggggaanannngttggggnggggggggncnagagngggggggncnggcnganannangcnngggggggggngagcagangganggngncaagggggngnngggngnggngaggnanagcangngagggggaggnngaagagngnggagagggnaggnnaggnggngngnngggnagnancgngngaggnagnanaggggaaggngnagnggngggggggngangagggggacgnnnnnggnnngcngagnagnnggggnngngnnanncnangncggnggangnaangnnanggnnngnggcnngcgnnaagaggnganaangggagngcgngggggggcggngngancgnggnagnagnganngnggcnngaganggngagngnngnggngcgaangggnnnnggnngnggggngngggncgagagnggnnggngnnnggcangtnaaaggnnnagggnagaannggnacacggaccgnnngnggagancgnggacgaaanngnnnagacgngnggacgaganacgcgnggnanngangnngggntggggannagaggagcgcgngagaacgcncnnnnggagannganggagngagagngnggnacgggnnnanngcgngcaagagagagacgagngacgcggagngngagagagagagacngaggagagagannnaagacngacggagagcacggcggaggnnnncgcgacgacagagaggnaggacgnaganaggnganncganngagagggncncaccggaannacgnngagacnacnnagngngcgaggaacacggngcgcganaggaggagaacncgnganggangacgncgngnancggnngacacgnangcgngagagannnagagagggacgcacgaagnncggaagagcngangggaagannannancgagnnngagaancggagngagcanaagggaggangggtcagangagaganagcacaancgngagaggnngannnaggacgacggnggagagagaancangngggnagaagnncngancaggaagggcgngggnaggngcgc

SEQ ID NO: 4725 - DNA, 1359 bp, Homo sapiens
  misc_feature (1)...(1359): n = A,T,C or G
aaaaaaaaaaaaacccccnngggggnnancccctnctaaaaaaatnnagnnacctnctgnnaagggcgnaaaacnnnncnccctcnnancaanatnncagnnccccccctaaaaaccatccagggaanaattaaagggggcgtncctntggggggggnnnnnnnnnnnnnnnnnnnnncccnnnnnnncnnannnnnnnnnnnnnncncnnnnnnnnnnnnnnnnnnnnnncnncnnnnnnnncnnnnnnnnnnnnnnnnnnnnnnnnnncnnnnnnncnnnnnnnnnnnnnnnnnnnnnnnnnnnnnnncnnnnnnnnnnnnnnnncnnnncnnnncnnnnnnnnnnnnnnnnnnnnnnnncccnnnnnncncnnnnnnnnnnnnnncnnnncnncnnncncnnnccnnccnnnnnnnnncccnnnnnnnnncnnnnncncccnnnnnccccncnnnccnncncnnnccnccccncccancnnnncnccncnnnnnacnnnccnncnccnaccnnnnnnnccccnncnnncnccnccncnncncnncnccnnaancnnnccnncncnncncnncncnnccnnncccnncccncnnccncncnnanncncnnnnnnccnnccnnccnnnnncnannannncnncnnnnnnnnancccccnacnccncnnnccnccccnnncnnnncccncncncnncnnncananccnnnncncncncnnnnncnccncncnncnnncncncnnnancnnnnccnncncnccnnnncncnnaccnnncncnccnncnacncnnanccncncncnccncnncnnnccccnnnncnccccnnnnnncccncnnccnnnnnnnnacnnnnnnccnnnccncnnnncnnncnnncccnnncccncnnccnnccnnnnnncnnnnncncnncnncnnanncnnnnnnnncncnncnncncnncnncnnnnannccncnncncnnnnnnnnnnnnnnncnnncnnnccnncnnannnnnncncnnnnccnnncnccnnncnncncnnncacnccnncnnnnnnnanncnccnnnncnccncncnnnncnnnccnnnnnnnnnnnnccncnnnanccnnnncnnnnncnccccncncncnnnncncnccccnnnnnncnnnnncncacnccncccccncnnccnnnnccanncacacnccncnccncccncncnnnnncncncnccncccncnccncnnnncncnncccnncnccanannnncnnncncccnnncccnccncannncnncancacncnnncncncncnncnncccncnnnanccnccncnaccncccnnnncccccnaccnnnnnccnncnncncnccnccancct

SEQ ID NO: 4726 - DNA, 10 bp, Homo sapiens
  misc_feature (1)...(10): n = A,T,C or G
nnnnnnnnnn

SEQ ID NO: 4727 - DNA, 789 bp, Homo sapiens
  misc_feature (1)...(789): n = A,T,C or G
nngctctncnattnnntgnggncttgctcgntaccncnanncngnggnnaatcgattgggcccgaggtngatnnatgnatactactcctgcgcgtcagttctcactttttggggccctgccggctggatnacngtacancctaaannngganctnctacctggccctctacangcagatnatcanncnggacaagctaggctgcncgcgcacggcgctggagtactgcangctcattctgagtctcgagccggatgaggaccccctctgcatgctgctgctcatacgaccacctgnccttgcngncccggaactactagtacctgatccncctnttccanaagtgggaggctcatnnnaacctgtnccagctccntaatngtgccttctntgttccactggcntatttcctgctgagncaccagacanacctncctgagtgtgancagagctatgccaggcagaaggcctctctcctgatacagcangcgctcaccatgttccctgnagtccttctgcccctgctcgagtcttgcaagtgtncggccngacgccagngttnacagtcaccgctnctttgggacccaatgctgaaattaagccaaacncctgcccttgacccanatggtnaaccttgtacctttggnaaggtcacacttttttnttggaaaaanaacccnggcancnnttgancttggctggaaggaaaaacgtccccgangatcttcaaagcaaatggatgccggggaacccaaaccctggnaagcctggggagaaacccgggggaaag

SEQ ID NO: 4728 - DNA, 789 bp, Homo sapiens; identical to SEQ ID NO: 4727
  misc_feature (1)...(789): n = A,T,C or G

SEQ ID NO: 4729 - DNA, 1064 bp, Homo sapiens
  misc_feature (1)...(1064): n = A,T,C or G
cnttactaanngnntgctatcgntctttccgnangagccnagcgattcgagtggctgagtggaggcgcccagacctgggcaggcagcaggctcaggcccacacctttgngatttttgaaaccaaagcccagannatgatgtttacttntctctccctggctctgcccttcttactgcaaaccatgctgtgccttagggcccttctcatagntgttcctnatggccatgactggaacagggatgcaacctntttntacacaagcacagantagnttgngtgaagnntntttntnactccgtttacaccngtnnttcnnttctanntgccnanancttcatccaatcngntcannnnnntnnctcactcnnacccanccatccnannnntcnnnnnnaacnnnanttcnctnctntacntnccctaacncatcaatnnntttnntnnnnattannntctctnantatattnactcnatatcctcncactntttcatactcncnattactcttnncncntacnctcatcacatacncnttaatnnnnccnntnctntatacnancatnttcttnncantctacancgactatnatagtcntctatcnncntnnaagnctntntnaatnntntctctganacncctcttacgtgntcttactntacntcaatntngctcatcatcactctcnaacggtatacttcatttnngtgtatatatcccncatctnctntcancactcntctctctactntatntcncacttncgncacncacgatatannatctnctacactcanaatcacnnnttatnatcnttttatanctcnnantntaacngtcnttntctnnatcntnctntttcganatctcnncacntntctntntatncttnttcttcntctntaatatcnantcatcttagtctcnnnanccaanatntnancntncactctntctacnttntctnctnnnnacacttctactatctcnaatatatatcttnntancatannacnncacctanatnantcctctaanntaacttcatctnctntntactannt

SEQ ID NO: 4730 - DNA, 915 bp, Homo sapiens
  misc_feature (1)...(915): n = A,T,C or G
atnnanancntanaanctaaacnattnnnntatantnancntnnnncncttttnncnatactnnnntntccnnnnnttttttaagcnttctaaatgcttggcaatcgccncctantannggcntggngatncgcnccagnacctgctatagttnngnnacnnaccacacccttncannaaatcttaacaagggggnggggataaaanaaaaacntccacaattaccttaaaagggactcttatgntttcaactacanatagttgtaaaggatcatacacaanatattgatgatanttgaaatattcttagaaggggtgtgtntgtctanctgngtctaccatgngtantgtattcntgacaagcactntaaaatacctgntnatnnttctatacattacgnataatngccataanganttaanctncatatatntcatcanccctaattgaatcannnnnaaatattttnattgcccatnanatctaatttcacttatactatcccnanaatagtaanacnactacagctnnttacncnatntaaacctttnnnanntnncacaatatnatacgnnannccanttatcnattangnnttnnaanaancanaantncaannatttcctnatcnaaatcacaattttctncnnaancaaatantncattccnaccncnnatnccncagaaaatntncacctcctatcaatatancaatntattnanaccangnnncncnantncaatgttttctcancattnnncttntantctatntactncnttcnnttaacanatatnttcanaantccanattncatttcacttntactacaccnnaacaanacntcaaaatanaagtncanatacanccnaantcccncatntannactntannacncantattnccntncn

SEQ ID NO: 4731 - DNA, 1479 bp, Homo sapiens
  misc_feature (1)...(1479): n = A,T,C or G
agcctcttaaactncaanttntaacttcnnnangcnaaacgncnctctatatatcgcngtancnccttaaaacatcatganattatgggggtcttttngggggngcnnactaccatctatcatcnctcncnnntacnangaccccttntacnactactntcnctcttnatgannngctccgtctnncnnnctcnntannnttatctacnnctctcttctcncctcntcatnnctnncnaancattcctcncctcatatcnactccctctcaattcanccatctatatntctnanatcntcancattacgntattntacnacacactctcgnaacncgctctntnagatnntctctcactacncnntancatnnntcatcatcanncnatantcttcanacagnncccttcctctccngcatctccttcctctcatnctnncnnattnannnncntcctactcactnntccctntcncaccnnancntanccncccntatnntcncccccntgccntnntactccctnccccnttcatccccntntccnactttntcancnnnctnnccttactnnatctcntctntatcnccccattatnctnnnnnncctangacncnnnnctntcaattttccccatnnccnccnnnttnncgctnnnctttcngcntctcncnttacccnttntnctannnctcnttnanctcnncccnccctctttncantcgancnatcnncccctcnacnatctntannnncttcnncnnnnncntatcantcncctccncactcatccatctacnncaccncactctanactntnnccactncctccactctctcctctancctcnctctcanntnatccttctcctcntctcattannantnanctcccntttnaaatccntcacncatactnaccatcttcnccaactntntcttnnntccnattncatntcctcccntaanntanncaatctctctnnttcactcacanctnnacactccattctcnntannctctcnacanncactcancttcnactcatanactcacactanccnntttnnntcttacantccnacncntanatttctctccnnntnnatcacanaaccacatctatctactatcttatcactccntntctcacgtntctctctcaccntntatnctnaactctatatcactcaanccatactctnatcanatcttgctcncacctatatnctctctcncaccctactcnctcctacatgtcnacatcttccntcnctntataccacncanttactnactnncnccanactcngccntacnctactacactgcantctctatctcntcnctcgacacncncttctngcnccccactctcntcttntctcnnnctcnactctctctntcnantcnactctcccncacatctatatntattctctctcctatctccnctcccctcctactcanaccccg

SEQ ID NO: 4732 - DNA, 1764 bp, Homo sapiens
  misc_feature (1)...(1764): n = A,T,C or G
cnaccctncaaaaaattcatataccanacanntnaggcctcttggnannggcnnccttcnnaacatnaattgcnagtacccnccttnaaaaaaccatcatgnaaaataatgggggngtcttttngggggggnggnacnnaantcaantcaancccatnaaaccacnaanttcncgnaccccttaaaccgtnaananatncactancanannatnncctaagtnancnttcctgnnnctncncnnacaacctaccctctantnntcccctcctattnnntncntnctcccacnancnnncncncntcctcncctacatntnttccanataacncctcacnnnccctacnnccnccacatctntanaaccccancacncctccccacctncanncatcnnacctactcnactnnacantccnccncctttctcnnctcnnntanttcactacctcttnnactaccccaanatctacntccccctctctccacncacanttacnctctcancaactnccanccatnccncnccatanacacctnaccncnccntnttctccccntaaccaaatnacctccctcnattcatnantnatnnnnaccnnctatcccaccncantanacntcccaccnnactaactccaccacctcccactactntctctcctaatcnacnctancncntccaccanntcantcctnctcantctcnnacaccnntnntacnatccatnnctcnanaccntctnntccanacccctnctntcaatcactnctacatatncccatcnctatatantntnctctctcatctcnatccaatcctcnccncatacanctctntacatctctcncnctcatcactnantctnctcnctcnactnntntcacncnacactnacntntcacnnactatccnacaccatacattctnctccannnctaatcaccacatctntaactacnnccacacncancnncacnacncccatacnctcctncacncnctcatnnaccaactccncnncntancatcncncnacactacacaaccatcaannannntcctctcatannacacctntntntcaccacntcnntntcactacactcactataannctctntncanntctancatacctctnnactntcnaccactctccctcactcactctccacnatcacntctctcacactcatatcatccnctactctacncnttaacnctcttatcancatacatntcatcacttcnaacncntctntcncancanctancatactcncctnntncntcncactctctatccntacanctcaatccaattcccactncnctcatncatntcncctcacnanctcacctcattntactcactataanncctcacctcacccnacactccccttantcccnnctctcctactcacactctcactcactctcncctcnacatcctcancnnttcncanctcacnctatcnncnatatatntcnctaatcatcncctntcacanactnctntcacactacacncaccctnctcanctnctnntntccctctctactcttctntccancacatctctctcactanacacncatntccntccatcanancanatcananacncctatacacnntncatactctntntatcaatatcccctntcaaactcnctcttcttannactacnctatcactntcnctctcaactnctactatatctcactcantctcnnacnctacantntcnncnt

SEQ ID NO: 4733 - DNA, 953 bp, Homo sapiens; identical to SEQ ID NO: 4718
  misc_feature (1)...(953): n = A,T,C or G

SEQ ID NO: 4734 - DNA, 1046 bp, Homo sapiens
  misc_feature (1)...(1046): n = A,T,C or G
gtanctnattnttttgatggnctaaatngccctaaataggnnngngtnggggncatacnncancnangtncnnaaatactnnngntacananctatggtcancaacatctnactnnaaacccttatgntaaaaanaaacnncttgccttcagccttcaagcnattatatcngctctcatccctncngnntacgncgnnantatatgtnccntnccaccacnanccagttaatnctnaagtatcnanatactaccagcatgggtantcacaanctgntncnccagcnatnctnaatntctcngngacctccnganccnnncncntnnnnctnnnanngngcngncattacannccntnanccactgttnccngacctcaacnntcttaccaanaatgtnntnccnntgnatgnanttttacatggcnataacactattgcntttncaanntcccnnacctcttcnntanccaananttnnnntnnctngtcncananntgtcncctcattnnnannnctcntgtnacnnnntcnnnntactanntagcactatnattatacngtnnatctntacanannctncatnnctanatnttacncnanattccctctttngctcacttnncatatacttctcancnnactctcgccgangtctctcgnnatatctnantanctnatntntgnnnnagcatcatatntgctactctanaaantcnatgagtaggaatactnnnncttcannctcanaaacactctatntncacatctnncacacacnnntagtgcatatanantcctcnngangatcnaantctcctnnanctcgnctcnntcgtnnctncanacgcnntcactngattctntnnntannnacaaanacnatacngcanaatnacatncnatanannctntntcacgnnncatcgtatntctnantntnntncgncannctnctncntgctacacatntatancatntnntnatcantctatncagancantnttncatcaaanacnntncctncagcngtnanncacctnct

SEQ ID NO: 4735 - DNA, 1337 bp, Homo sapiens
  misc_feature (1)...(1337): n = A,T,C or G
cccnnaaaaaaattnnaanccccccgncgttaaaaaanccctcttaaaaaaaatttggnngcctnctgnaggggggcnnaaacnnnncccccctcnnancannatnnnngnncccccccnctaaaaaccatccagggaacaatnatgggggcctncnnttnggggggnnccnnnnnnnnnnnnnnnnnccnnnnnnncnnnnnnnnncnnnnnnncnncnnnnnnncncnnnnnnnnncccncnncnnnnnncnnnnnnnnnnnnnnnnncnnnnnnnnnnnnnnnnnnnnncnnnnnnnnnnnnnnnnnnnnnnnnnnnncnnncnncnnncnnnnnnnnnncncnnccccncncnnnnnnncnnnnncnncnnnncncccnnnnccncnnnnnncncnnnnnnnnnccccccncnccnncnccccnnncncccnnnnnnccncccccncnnnnncnnnnccccccccnnnnnnnncnnccccnnccncncccccnccccncnccccccccccccccccncccnnccccnncccnccccncncncncccccnnncccnnccccnccnnnnccccccnccncccccccnnccncncnccccccnccccccccncnnnccccccnccncncccccccccccccnnnnccccccccccccccccccccnncnccnccccccccnnccnncncccncccccccccnccccccnccnccncnnccccccnccccccnncccnnnccccncccccnncccnccnncncccnnccnccnnccnnccnccncncnnnnnnnccccnccncnnnncnncnccccncncnccnccnnnncncnccnccccnccnnnnnncncncccnnncncnccnnnccncnnccnccnnccnnnccccnnncnncnncnnnccccnccnncnccnnncncnnnccnncncnnnnncnncncnnccnnnnnncnccnnnncncncnnnncncnnnncnnnnccnnncncnncnccnncnncncncnnnnnccnnnnncnncnncnnnnnnnnnccccncnnccnnccnccnccncnnnnnnctcncccncnncncncnnncnnccnncnncnnncnnnncncncncncncncccccnnccnncnncnncnccnnnnnncncnccncnnnnnncnncnnnnncnnnncnccnncncncncncncnnncncnnncnnnccncnncncncnccncncnnnnnnncncccncncccncccncnnncnnncnnncncnccncnncncncncnnnnccncnnnncncccncnccnnnncnnncnccnnnccnccnccccncnccncncncnccnnnccccc

SEQ ID NO: 4736 - DNA, 1312 bp, Homo sapiens
  misc_feature (1)...(1312): n = A,T,C or G
ccctnaaaaaaaatttggnggncccncgggggggnnnnnnnnnccctttaaaaaaatatggaggcctctgnnggggagnaaacnnncnccctcnnancatatncaggacctcctcnaaaacatcagganaaaangggggtctgggggggggncnnnncnanncnncncnnacncnngcnanncctnaanccnnnananactnnnnnnnncnncnnnnnnnnnncnnncannccnncncnngncnnnnnnaccnncccnnncccaaccnncnncccncccncncnccnnnnnnncnancctcnccnnnncnncctccnnncancnnnncncncnacnancnccacccannnnacnnnnccncccncnccccncncncnccccancanccnnccccccaccnncnnccccccccnccancnncaccncnccnncnnccnccncncacccnccccacnnncnncncnncnnccnccnncncncccccncnnnnnnnccncncnnncctacnnccnnnncncnnnnnacnnnnnncnancnncncnacnaannancnacnnncnncccannnnnncaacanacnnnccncnnnnncnccncnnnncncnanannnncnnacnnnnnnnnncnccnnncnnncnnacncnnnnccncncnannnnncnnnnnnncnnanncncncncntncncnancnncnnncnncnnnnnnnncnnannnnncnacnnncncncnancnnnncnccncnnacacccancncanncannncntnnnnnnnncancnncncnccnnncnnnncnnnncnanccncncncncncncnnnnncnnnnncnnnnnnnncnnnnnccnnnnccnncannnnnnaccnnnncnnncnnnncnncanncnncnccncaanncacnncncnncncncnnnncncacacncnnannnnancnnanannnnncnnannncnannccnccnnnnncnncnacncnncncanncccncnannnccnnnnnncnnncacctncnnnnancncnncnnncnnncnnncnnnnnnncncacctcnccaacnnccnccncncaacnacnccctancnanncnncccnannncncccnccncncanncnantccnnntccncacncntcncacccnanccacncntcccncncannanacaccncccccnccncccnccnnancnncnnccnanaacccccnaccnacccctncaccccncccccnacnccctcanncccacancccnccnccncannccccnacanccccacnnntccnnccctccnancnccncccccncc

SEQ ID NO: 4737 - DNA, 715 bp, Homo sapiens
  misc_feature (1)...(715): n = A,T,C or G
gtntttatnccngnnctcttgttctttttgcaggatccctcgnttcgaattcggcacgaggnactaggctcgcgnnntgtntnttttntntntntgatattacnccataggtttngggtnacnatnaatgtttgcattnctnttnaaagcntagctcttactaancattctttaacaaaagctaatnatcnnnanatnatttgccataccgaaactatctncncaaanaanactttannccantatnnnaagctnaaganttaganaaantacaaaacactgctatgagtcaatngaactgctatcattgaatttgctgcatttanaatgacataaacatactgaacatcaaaacaatggnatggatttattctatangactagccttaagaatgacatacanttngcganttcctttaaaaatnatnttttacnacagantccatttgaacnaagggtctttttttcccctcatttnangggaagacnntcnatgtttcccaaacnnatcctccnttcatactanantagcaaactgtggcctcnatctccnnttccagatgctacttatanatnacttttgcataataacttaaattagaattactttncttggnaacagtgtcacggccataaaatnantccanttttaaaaaaacanacttcaagngcaaattntagaaaacttcctttaaagaantaccnaacccagccc

SEQ ID NO: 4738 - DNA, 706 bp, Homo sapiens
  misc_feature (1)...(706): n = A,T,C or G
nctaatgctggctacttgttctttttgcaggatcccatcgattcgaattcggcacgagggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagcccacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttnccaaaaattgcactgtgtgcagtttgcaacaaagaatn

SEQ ID NO: 4739 - DNA, 706 bp, Homo sapiens; identical to SEQ ID NO: 4738
  misc_feature (1)...(706): n = A,T,C or G

SEQ ID NO: 4740 - DNA, 1446 bp, Homo sapiens
  misc_feature (1)...(1446): n = A,T,C or G
cgggntttaaaactnctaaatanntgngcttccantaggngaaaacgtgcacccttaaanatatttnagnccnncctnnaaaanatcagggaaattatgggggtcntttnggggggnntctcagctntantcntanantatntatanannncnncnnannnntacanaagctcaatatgnnatactncntnttcacgtnantatnacncatantnncnatactacttcatcntcnacaanntccgcantnncnanattattntnttcttcataatatccantatnntctncattaatcanttcncatacttttactnatcncttnctctcntctatacttntccatnctantctactnncccttcctnnnaaatntantnntnantncctcaatacannccnntcatccttannnnnnntccncatanacantnanctttactnccncncacctttcnncaataattcttanacntnanacnctnnnnntnatncatanatcacntcntnanctttnannatcntaccacnnannncttntactnctnanacnttattntnatcttnctcnatatacttcnacanatttctcnttanttttatcnanactattcancntactnatnatnttcctattctcactnaananatntntnncntcaatntcatatnctctctnttnctcttnntctcntactantntncatcatncctnatctaacatntctctcntananncactcatnnctttattatnatanactntattnttnctaatactntantcnatctctatctntntcactncnnatcttnanctntatatnctatatcatctactctcnccantaccntcctnaacnntatctattanncacacatcatctnttctanactntctctattntancntaatcntcncncatanactngtttntatcnctnnctnctcantcnctcnncanactatactntatngctnntanctactaatactctctatcctncnctnnanatntaacagtcactctnatatantatnnttntacactcanatcacctctcncttanantntcacacacatnttatntataatatntccatatcacaagcatntacnctntacacacatnntantctcatactcanctctanntcacttcacnnatgactctcagtnctaccanctncctcaattcaatcatncgncanctntntatcacttcntaattatatatntcttaagtccnanatgtnactaantgactatntnaatctntcatnntctaacntccatatcacatntctactatcaatatatacttanaatctcaagtctctanatcccctcaacacctacgntnctactatatatcatnttnacntacannnntctatatnntcacaactatatntanannttanntacnctgntntatnnanat

SEQ ID NO: 4741 - DNA, 1446 bp, Homo sapiens; identical to SEQ ID NO: 4740
  misc_feature (1)...(1446): n = A,T,C or G

SEQ ID NO: 4742 - DNA, 734 bp, Homo sapiens
  misc_feature (1)...(734): n = A,T,C or G
tngtaccaattatctgctggctanntagcctaaanagnttggtcngggcgaattcggcacgagggnaaagcagnaagtaatgagcttgtccgtcagctggtagctttcattcgtnaaagagataaaagagtgcaggcgcatcgaaaacttgtggaagaacagaatgcagagaaggcgaggaaagccgaanagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccnaggacgctgagctctatgatgacctttactgtccancatgtgacaaatcnttcaagacanaaaatggccatgaagaatcacgagaagtcnaanaagcatcgggaaatggtggccttgctaaaacaacagctngangangaacgaagaaaatttttcaagacctcaaattgattgaaaatccattagatgacaattcttgaggaagaaatgngaaagatgcaccaaaaacaanaagctttctacacantnaaatccnannaactccatccntctanaactatnngtgagtccttnttacntcnatccagacatgantancnatacnattgatggaacc

SEQ ID NO: 4743 - DNA, 1226 bp, Homo sapiens
  misc_feature (1)...(1226): n = A,T,C or G
nnggggttnacncttctaaaatnttnnncttncnntgngncaaangggggcccctctnannatnttcaganccncctnaaaaanatccagggaanattttggggggtctttttgggggnctcctttatnancnatccannnatatncatnnttcnctctanatgctnannncanatatattcaagatcttcnnctcncntcanctnntctcatanntacttaactnataatatcatattacactcntagtcttnctaccacanccttnnctcatttaatnacncctaantcactctattntnccntcatntanattnnatcatcatncactcttntttntnttatctctanctanancatcntatatttctactcaanaattatcnnncnnntantcanatcaccnctcataatnttntnnnnnnnttnccctaanacctntactantncantctnantncnnctnnncnnnttccntnctcntnnttntnntantcantntcnncnncntcnnnttnctntnntanatcanccatnntcttgcnnatttcnaccnantncatatcccancctntanatntacatcncntnttctactnnnctncnntntncctnnantncttancatatatttantnctntnncanatnatattannnttcctnttnatatntcttactattcnctntccnatattcanttctatnacntcanntactcanntnncttatgntttatcctcttatctctatctntcncanaantctctacactnncnnnnttatctatcntctancactcttactctatatcnttntatttatcactcattccacnctntcctcttntctcanatctatncactatctacctatatatatcntattntncttataccncctatattctntaatcattcatanntaccaacntacatcattcncaccttntatacctcatnatctatnctattctactctacatacanctcatagtcantantctatctcanctcctcancatctcactcnnnatctaacntncantntatctatctctccnatctatattctacnctatacnacactacnctctcttnatnnnctctntatntcnntcttantattntctctanntccntatntatnctcatcnnacanatatccatnnttgcncnacncnannatctncnctctctctnttatctanactgntctntctacanc

SEQ ID NO: 4744 - DNA, 747 bp, Homo sapiens
  misc_feature (1)...(747): n = A,T,C or G
gnnnnngagngggggnntttnnnnnnaccgaagaacncntggaaaccccnttgaattcaaaaccatgnncacaagctacttgttcntngagcaggaacccatcgactcgnaanttnnccgaggggaggaggaccacnggcgcccggncagccacaccnngaaatgggggagcancgcncngggnaggggggcccanccgaaaatgnggcagnccgnaagganaaanacgcaagganncagagcaggcccaacngnggngaaagggaanagcannagccgcanngngggccgnaacgccncgcacaaaaacatgcggagcaagagcncccatggagaacnganggggccccgcaaagnagcgctagnncaagnnagnacgnanaacncncangngaangtggcngcangagnacnacagaaancgactgggnacccaaggccagccngacaacnccancnaaanaccganctgnnangcngcagagnangaactgggatgaaacaaannaggaagggcggtggcgaagaggncaactaggcagcgaacaaaaccnccaccaagnggancaaggangccanggngagacgccagacgcntntgcccagatcaggaaacgaaagggacnnangncgacatcnanancccnagaagngaacaggagnnnacgcaagccccncgacnanagaagngagatgggctgaacagnnnannatgtnatgngcagnnnaanagagngctcaacgnaa

SEQ ID NO: 4745 - DNA, 1064 bp, Homo sapiens; identical to SEQ ID NO: 4729
  misc_feature (1)...(1064): n = A,T,C or G

SEQ ID NO: 4746 - DNA, 1471 bp, Homo sapiens
  misc_feature (1)...(1471): n = A,T,C or G
ccccnngcacacaangncncanannnncancganngagcgntgcagagacagcgcgnnnacncnnnnncacagccanncannngnnancacgacgnnngggcnggagnacgnaganncncnnacacnnngnnngnanaannacngnanacacnnnnggnacgcngncnncgagnacnnngaccncagcganagnnncatannnnggggggcnnnnagagggagatccgcgcacagnattgggcantccttttttgggnnaaaacccggnttgggagaaaaaacccccatnacgacagngagacagaggagaganngcgcncnnngnacccagncacgtncgcgacgtccgancagccccgacgcnggagcgaggagcntagnaacnnnccnccacnncncacgcnnnaanacnnnnnangggggngacgatataagcaccgancngcncannatctcnnantcannannnncacacnccagcaanngcccnncngcgncannnaannccagnaacnnaggcncnnanannnncnanccnncnannnnngnggacnnnnnnnnngnnnnnngcgcanancncccgngnnngnnngngaccanncccgccncncnnnnnnaaannnanannctaacaaactnnnnnnannnnncncngncngcnnaagnacnncaggannnncanncancannccncnanncaccnngncnccnnaanngaagnantcnnncgncanctnacngcancnnacgnccangcncnacannancgcnanancntgncgagacatanncgacgaganncantngcnnntnnncntantntacannncgcccganagcntcngacagncgntncgtcgacagcntnncgcacacnntggntgantccngagncatatagaatcagcgnnnangcagacacnacanagagnangncanctcnacgacganacaacatcgcgnngantcannnnggngacgantccnaannancagnngnncntacgcaganccccaccncgaaannnatncanctanncagctngcnanggacanacacgcgngnnggcacaagacgagccagacngcannacgcgngngccncactngnctcacgccacagaacannntacacnagcgccngcnagagcncacacagnggtnagananggncncgcncntnnatgccatgngaaccacgnagacgcaccgagacatnnnacaangcgctcgcgcagagncnanncncnagacggccgtatnagnagngagncacancnanngnnngagcagcnnnancgcanagngagagagcacncagngganacacgccgtagaccnnnntcnggncgcncccgcncnggnagcanntnnnnccnntntagacanncagcgntgnnngacatanngnaccatcatgtacncagccagcnnantagagntncncanacggcagcnagcagcacnnnc

SEQ ID NO: 4747 - DNA, 915 bp, Homo sapiens
  misc_feature (1)...(915): n = A,T,C or G
cgaccagaacngcctngaaatcccacaaacgaggagcaancgacgcgaagacggcacgagagcgcgaggcaacgnccccgccattnntnnccacgctgggaagaccaacacccnccggagcgcgnancagcacccccacggcggangcaancgangaccnncggacagcacncacgggncgganccaggnacgcncgccncnngngcncggaaccnggaccagccaanagcgcngctgngccngacngagnncnccnaaggncganaancccgagcncgcagaagaanccccggggaacgagcngacggganccgcaaaaaggcaccnaagacacaaggcgcaccacgaggcncggaccgngncccngcangcccganagccaacacaggncannggnagngacgnacagaaccggaaancaacngccacacaaaggngccaaccgnacgcnacnggggggccccnacaagggnaaagacccaggaanccaagnggcccnggncnanccccnggaaanngaccnggcaannngggcnngaagaaaaaaccaaaggccnagcgaancngaaacccangcagccagagcacgnanaggnaagcggcaaanaaccgganaggccccagganggaccgaaagnaccgngggngccccaangcccaggcccaaaacgcncagaaaaaggnnannaaccaaaggcccagngngccccgaancaccnnnncagcaccnagganaacnaganagaaccgcgaccaacccnanaannccggncaaannacanaanccatccncaggggngaaggancacnngccnnnccncnanncaaanccaaagccnncacaaanggccacaggnccanagcanncgnacnaccgccanacaangcccagaananncgggggannggngccg

SEQ ID NO: 4748 - DNA, 789 bp, Homo sapiens
  misc_feature (1)...(789): n = A,T,C or G
gtttnannancagctcttgttctttttgcaggatcccatcgattcgaattcggcacgaggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatnagatnatgggaacattatgatccagaaacacgatggcatnacggtggcagtgcacaaaatggcctcttgatgctcatatctggtcttnancaacctgtnntntgaantcgngnacccncnatgtgnaaatcccctntntaacttctcaagnntcncnngtttnggncnttcttttaaggtgccctttggggccttttctggggnaanttttaanaangcanannngcgntttttaanagggctnttttnggccccccctnnttttnnaaaaaattttttnnttaaaaaaggggggattccnttnttttnnaaaaaanccaagggnnncnnccgggggccaacntnnnggnattaanaaaaattttnggnnggtnatancaaataaaantnttnttttggganggaaaatttgnaaaaaannnnnnnnntnnnnnnnnntnnnnnnnnnnntnnnnnnnnnntnnnanncnt

SEQ ID NO: 4749 - DNA, 10 bp, Homo sapiens
  misc_feature (1)...(10): n = A,T,C or G
nnnnnnnnnn

SEQ ID NO: 4750 - DNA, 749 bp, Homo sapiens
  misc_feature (1)...(749): n = A,T,C or G
gagaggnnnnttttnaanatcagctacttgttctttttgcnggatccctcgatttnaattcggcacgaggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttntatgggctcttncagagacgtgaactggaaaaggctctgcantgtctgggattcgctcaatgctgcaggggagggcaggtgtgaggggaatggccctggagggtgatggggctggggcatccgatgcagctttatagttctgtaattaccacttttaaactttttattacgaaaaatgtcaaggaccctggaattaccgtgaggtaggcaggataatgggcccccaagatgcccgtgttgtgacccccaagacctttgtgagtgcctcacatngggaaattggcctangtcatcttgcangcccanggcaagccccattggcccttaaagcttganancctttcctgctggantttganagatgccngaancannanaagntanaaacccctnggaagggccntacttcct

SEQ ID NO: 4751 - DNA, 708 bp, Homo sapiens; identical to SEQ ID NO: 4677
  misc_feature (1)...(708): n = A,T,C or G

SEQ ID NO: 4752 - DNA, 737 bp, Homo sapiens
  misc_feature (1)...(737): n = A,T,C or G
ggnntttnantctacanncnactggctacttgttctttttgcaggatcccatcgattcgaattcggcacgagcttntntggnctnnccgnctattntgnnatcagagnngctgggacagttgntgctnncctnnntnacgnnagngnttnnangnatgatntctatgtgnannacatcnngaannagnctangaanaatgttgacnccantgtttnttnnatgannactcgaanatncatatatggnantaaangcaaanctntanncttgnganngnngnctagtatnactcacgcgcccngcnaagaccctgctcntcgcagnannatacagtatgctattctggacttacngagtcngttcnagcataatggattccnttgcctcgctacntgnnncaganaatctcanntnctgttnaccaacctnncnangnnatnnccctanttacgcctcganagnatgtgatatnntaanntgaatnatanatctgatgnactactgacagcttctngatgcctgctcaggataatgcctggngcatntgacatcaatancaacctngntntnaggctctantccttgaangactntgntaatgcntacaatgnttataannttgnccatccacaatntgaaaatcaggagcttgacngcgntatnggncaacaactnctacngaacntagtgaacattggatgaatatnntaaagcctggtangcnnatattnggatn

SEQ ID NO: 4753 - DNA, 795 bp, Homo sapiens
  misc_feature (1)...(795): n = A,T,C or G
tgtacnaannantgnggtngctcgtnctttctcnnaanannnnngcttggcgaattcggcacgagggaaagagggaagaaagagaagctggttatttctagaggatgtcgtaatctacatcacaggcagaactgatggctcagtggctgagtggccagtatattgtctttttttttttgagacaaggtctcgttttgtcacccgggctggagtgcagtggcgccatcttggcacaacctccacctcctgtgttcaggagaattgcttcaatctggaaggcagaggttgcagtgagattgcaccattgcattccagcctgggcaacaagagggaaactccgtctcaaaaaaaaaaaataaaagtgccttttaggccggaaaaaaaaaaaaaaaaaaaaaaaaaaactcgagcctntanaactatagtgagtcgtattacgtagatccagacatgataagatncattgatgagtttggacaaaccacaantagaatgcagtgaaaaaaatgctttatttgtgaaatttgtgatgctattgctttatttgtaaccattataagctgcaataaacaagttaacaacaacaattgcnttcattttatgtttcaggttcagggggaggtgtgggagggtttttaatttcccggcccgcgccaatgccttgggccccggtacccancttttgntnccctttagtngaggggttaaattgccccctttggcgtnaatcatgggccataacctggttnccngtggngaaattgnttattccgnnttcnnaatttccccananct

SEQ ID NO: 4754 - DNA, 751 bp, Homo sapiens
  misc_feature (1)...(751): n = A,T,C or G
gagagggnnntttcnaatgccagctacttgttctttttgcnggatccctcgatntnaattcggcncgaggcncncnctgcgctccgtgnctcaacanggcatgccnntntctncgtacactatnnagngagattnntagggactatggtnnagnanntcngtacntgnnaaaggggganctattgcatctanaaacttaatnatntaaaattgactnatttagactagactcaagaatgtatatgctnttggtaattaggaactctngagaatanaggctgctgattgttgccatancatgtnctacaaaatngnatctctatgggatgtactggcaantgtgtcataaaatgctnctgggttnattcatncattccataagaaacttaataccancnaatgcattaaanccnnngcnagttnccatnaactgtanctatgnaacntttgtttaaggatcnntctgatggtcntntangagcnatcttagntctnagtcattggnccnatccntntnctgtgagtaccagnacataccgaacttgnntnccctgcttccactaantccagntgtgaccaaaatctaacgtgacatcatacganangttatagacanaagactantgagatctaananntcctgcnttnnngnnaacccnnctacaaaanantannatngngggaanaatnntnttnccctttggaccatttgnccntcaaatatnngccnccngaatgaanntnaacccnn

SEQ ID NO: 4755 - DNA, 963 bp, Homo sapiens
  misc_feature (1)...(963): n = A,T,C or G
cnaannagtganngngtcgccttgccnaacnannnaggcgggggcgtcttggttntctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacatncttaagaattaaaaaacgccatttcagaagagatgatagttttatcttgccaaggaattatcttcttagtagcctatattggcttattccaaaaaaggcgttaacctccatcaaaacatctnctgcgcctctctctcagcatatgctntgatntttgaagngtgnaatagattggagctatcagtcacttatttcnaaaaaantgtnttctntnttcttcatancctgtgaannagggatacccnaggnaaagttcctttctgctgtcctccctcctttggtaatgcttatccttatggaaccactnaacctgcacaaaacccttcnccttaaaaanccangnnaanntggccaanttcttnaattangccancttattttatccccncnggntcattaaaccnaatntcttaggcctggctntggggccttcgggggggccttttnggccttgcnnntngcnntnttaaaantncaggccttncnanaanancanctctntncntctaccgannaanaaccctctcnananggnccctcttcttcananaacncttcttnagctcggagagggncccgaccaatttnaaccgcttctntntntcccccncggtgtcacctttggcttttcncnnncantcncncatctttntgcnnantnacnnnnnattnntgngngcanacacaacaancncccaactccacnctcntgtnnan

SEQ ID NO: 4756 - DNA, 707 bp, Homo sapiens
  misc_feature (1)...(707): n = A,T,C or G
gttttaatnnntcagctcttgttctttttgcaggatcccatcgattcgcaagattgggctatggaattggaaggcctgttttggagtactctaaattaaaaaaaagttatatttgtaaaataaccaccacaagattgcctgattcacagttcttctgagtattggcgtaggtaattatttaagatgtttgataaattgtaaaatgctttttacattttttaaggaatcaattgaactactggaaaccagtatgtagtattcttggcaggtctaggtttcataatcctaatttctttgcagcccactattcagaaatgtagtgattaacagagtcaagaatgtttcaggatatttttggctacaagtaacaatacctaactaaaagtgacttaaataataagcagtttgttatttcacagaatgagaagctcagagccagagagttacagggttggttcagcagttcagtttcatcaagaacataagacttgcttactttaaagctcctctgcatgtcagcagagggctgccccaattttagataccaacatctggccaaagaagagcagggaatgcttctttaagtacttattanggagcaaaacttccttaaaagtctcataggaggtttttccttagnctcattggatctcaatggctcttgcatactagaaaaaggccacattccttactctggcatttaagtt

SEQ ID NO: 4757 - DNA, 707 bp, Homo sapiens; identical to SEQ ID NO: 4756
  misc_feature (1)...(707): n = A,T,C or G

SEQ ID NO: 4758 - DNA, 707 bp, Homo sapiens
  misc_feature (1)...(707): n = A,T,C or G
atgcggnccnaatnntnggctactcgntctttccgcaagancccngcgantcgaattcggcacgagatttgggagtnntaatatngacattnctgngatgctnatatatgtaatgtcttaattgagattnctgtnanggcanaaataattaggctagggctcttagttttcattcctattgcccaagtnttgtcaaactatggtataattttaatgttactttaaaaatccatantctgctagttttgcatgtncttatatgaaaacagtgcagtaagttgaaaactcagtgtctatggaattgataaatgtcgatctggtgtagtatattttatcgcatttncttatattaaaaaatgtctgcatgattncattttatttcctttgtaatttacatttcagaatagtgtattgctatatgggtgccaagattgaatatgaagaacccnagtgtttgtagtattatagttttaagcaaatctgtgtggngatacagccatnagantggggcttatataaactctgaacatgtaagattttgtacagagaatcnttaactntataaattgtatatgancatgtaaatcttttaaaatgtacatnanatactgtatttcattaccttgtgtgtnatagtctagtcattgcctgtnaatataatttattacgtnntctgnagcataaacccatacatngatgacttannt

SEQ ID NO: 4759 - DNA, 842 bp, Homo sapiens
  misc_feature (1)...(842): n = A,T,C or G
annncnntnnannantncntnntnnnnatcnnnntctnnntncntntnnatttaannntttatannnnnntntnannnnnantnntaatnatgttnntctaatgnnggctnctactcttgntgnttgtgcagtacccnnggattcnaatacggcacgaggcaagttccagtgaaccacaagtatggcaaancttatccaattttatgctnggggcagtcagnacataccagtttctgatgtttcaggcatgagtggggtaaataagtgtgaccacttaaagctgntcgttagcatggaagacttctccattctatctttgnaaaacagacaanatatgcacttgacatattagcaaatnggtnctgaattatncaactgtttgctatttantaaactagcaaatgatgcatgtattntgtttttcatgtnctgggcaatatgagtaaaatctgtccctttttccccctntgaatgaggtctnncatgnttgangnaaagtnttgcactatngcatatantnnggggacacagattttcataatntccattttttgggggcttaaggatttntttttttcnntgtgaaacagtnataanncttanncnatatnatancttnaaatatntaccaggaaaantcctttttgganttttcaaagccttnnattaantctantttttaaagaaancncntatgttatatttntnaaaaggttnttttncccccaanccttanttttacctgnnaanncttgnttncccntttaatantatntttaccaaatntcccnatttccngganaatntnncccttcccntnccttgaaaaacattgttttnc

SEQ ID NO: 4760 - DNA, 843 bp, Homo sapiens
  misc_feature (1)...(843): n = A,T,C or G
tganctcatntctcaagnagnctanatngccctaacnagaatngngctnggggnaattcggcacgagctagcagtaggnaacaaagtataanaatgacagcagatgtgtggncanaaattattcanggcnnaagacantngaactgaaaannaaagtaggtcaatctagaattctatacccaacacaaatatccttcaaaaatgaaggtgaaataaacactttttgatggacaaactgaagttgagagaattcgtnaccagcagacctgtagtacaaaaaatgttgaggcaagttttttaggcnnaanaaaaatgatactanatagaaatttgggctncacaaaggantgaagaggcttncaaatggtnnnattatntggaancatatgaaagtnatcttttctcattntcaatcccttttgagaaactgcttaaagcaanaatatnnacnaggtactatgnagncttaanaacatacatanaancaaaatgtatgacaaaaactactaaagttnnccangantnntggtgtgtgcctgnngcnccngcntgtcttgtnnggctnanatggggacgatncattctnacccgagcccnnatangtcctaacctnntntganctgttgantggtntcactcacnccctcctgggctacacanntngaccctntcctgnaanccaaancccctctcaaccttccnccnttcttcnnanctnttanctgnannntccnttatncncccctnantccccccaccttcctccgnatcncctctcctgcancttttngctccncancctcccaacnntnngnnaatttcctcactgncanacacannnct

SEQ ID NO: 4761 - DNA, 718 bp, Homo sapiens
  misc_feature (1)...(718): n = A,T,C or G
gntnttnnnttntatannnacangctacttgttctttttgcaggatcccatcgattcgaattcggcacgaggcttctgtgtcaaaaaacaacaaaaaatggatattaggaacgttttgttgtttaaaaaaattactttgtttttacactttggtagaaaaaacttaaggaatatttcaaacataatacaaagtgagcagaatagaatagtgagcttttatgtaaccattcttttttttttttttctgtaaaaagagacaaggtcttgctctgtcacccaggctggagtgaagtggtgctatcataacttgctgctgcctcagactcctgggcggaagtgatcctcctgccttagcctgccgagtagttaggactacaggtgcacaccaccacacctggctaatttttaaatttttaattttttttgtggagacgggatcttactgtgttgcccaggctggtcatgaacttttggcctcaagcagtcctcctgctgtggcctcctaaagtgttgggattgagccactgtgcccagcccattgnttttattattttttaaaggtttatttttaggtgaagtttacatatattgaaatgcacaaatcttaactgtncagntgntaataagttttattgagatataatntatatactattagttatatggtncataattcacatgccttctttgaaagngtccannttcaantgaatttttt

SEQ ID NO: 4762 - DNA, 718 bp, Homo sapiens; identical to SEQ ID NO: 4761
  misc_feature (1)...(718): n = A,T,C or G

SEQ ID NO: 4763 - DNA, 768 bp, Homo sapiens
  misc_feature (1)...(768): n = A,T,C or G
gttanncctttcnaatgctnggctacttgttctttttgcaggnncccatcgattcgaattcggcacgagctganttgccngananntaatgngnngngncaagagactctnccantntgtaantggctanttagnntgnctagctgagcntaatnaaagnnagnaaacttttataactnattaatattctgagnnnncangngcgccantacnntatnccntnancttgnatctatgaccatatnaatatanngcataatnccgcttctatcatgagtanctactagaggnatgcatngcgtgtaatngtgangtaatncannttacngaaanttangtcttgcangnatanggntnnnnnactaatattttannatatagatatgacatntgtggaangagcactagagcntgcatctttnatatgntnnttgnctanatgancagcanngtatgnngntcaaanttatnanaactcatncnagtgtctgntcattcgaaccctacctgatantantctaacttgggaaaaaaaaantggtctgaatgntncannttttaagtgnctatcnccagagttggaaataatgccaanangcntnggtnattagnttcncacatgtanngttaggttttttggactnntgcnangcttactanttggggggaagaagaattcagaagccntggaaaggtnggtcngaanttaangaaatngtaaaanaaagcttggnaaanttttacccttggcaaggatngnntngccnn

SEQ ID NO: 4764 - DNA, 768 bp, Homo sapiens; identical to SEQ ID NO: 4763
  misc_feature (1)...(768): n = A,T,C or G

SEQ ID NO: 4765 - DNA, 1475 bp, Homo sapiens
  misc_feature (1)...(1475): n = A,T,C or G
actaactatcncacacnncnacgccnaaaatngccnaacncnnnnnaaagctnngggncnanacctncaccacncancacccaaaanaacaancnaaacaacaacagncccctcncacctnnannccnncccncataantacancctcccnatagctntcacccacacancacacnccntcaacccccancancctcccnacnccccacccaacccaaanacntnacntaannccacccccacnaaanacccnnncaacacnncacnacacncncanncctcacnccaacccncccacccnccncaaccnancnccctancanacccacccncaccccccccccaaacncaanccnncancnncnacnananctcaacccnnaccacccccccncaccaacaccctccanaccccanacccctnanacccccncaaccnnccacacncatcacnnncacaacatntacnncntcacncancaanacnaacacccaccncacacnnacacncacatcannnnatgnnctcacacccactcantntaccaanctaacaaccacacccatacgntatcncacacanncccacaacnncacatcacacccanccntcnnnaacccacnacaccnacacactccatacanccancncacancacaccaannnccancaaaaaccnacacaacacanannccacaacactctctntancnnacactctaatatcncntaaacatnacnctnanacccacactaccncaaccatnatnccatacacncacacanacacatcacaacncnctncctntcantctncacctacacacnatnncacanaacnncaccaccctnntaacnaacacannntncacnacncacaccaccacatacacccaacanctccctcnctcncnncacaccacaccaccaaaatcacccnnnacaactntncncntnaatnctnatatcnctccaccacnaatnntanccnacacncncannctctcacaacactctcncacanatantctntccntctngantcacacancannacaactnncccacatctcacannncnntanntnacctntcnanccaccacacatcacacacctcacannncctacntcacnaccanccacaccacnanaccccaatncnctctccanacacaacacnanacnnncctcannncatcnacncacatncatcaccaccnaccacnnaacacctnctcactacaacacncancnatcacccnacnccatcacacaccacncacancacaccctcaccacccaanntcacacactnctctccccnctctctccacccnncnncaatcnnncaacaccnncccacccacaccctctacnncncntacnntatctatcaccaccanacncacacatattcatnnncacacntcacctnttannaacttcacacaactatcnatncncnnntncct

SEQ ID NO: 4766 - DNA, 798 bp, Homo sapiens
  misc_feature (1)...(798): n = A,T,C or G
ggtnnatancagctcttgtcntgngccngatnccngtgaanatantctctctagctcacttgtntaaantgganagtctntnatnatcggtatgaacccntnaaggagccatgtntaccggnctagctatactngnccnngggaagnccctgcctgtgtgnantnccntnctgggatncttnaanagnaaacnnnacgctctcncanattcntnagatgcncagntagcttatnagncatgggattgccanntgnnccatctnctgtctnanggnctnccanngcacnngtttnncngacnaacnggnccnctgtgtaaatagnaggcngagaaatgatacnntgctgtggaannaccaaccnactatggaccngaaacttgctggcnaaatnaattatctncnacaaacngnaangtggctcngagattgatngttggctataatatngaagcccctgccctgtgacnntgatnctagtgattattgcatgnctcctcatctgtatantgaaanncatctnattaggnanagngtttnganacntttngaaaggncntactggnaatttacnttanaattntttnccattgtccgaccacaaanttncaagnttttccngncacatttnnnnacttaanggcccnggnacctggaagngctttgaaaaggcgcctttnaaaanngngatttagccngnttnatttancccnttttanaaacnggnnntcaggnccnccaattncnngaaanntaacctttagncctttttnaaaactttttggggnggtcngnnatc

SEQ ID NO: 4767 - DNA, 1861 bp, Homo sapiens
  misc_feature (1)...(1861): n = A,T,C or G
nacngngtnngtgaggcctaaatagctnnnctntngtgtattnnggngnaggtgcntnnatncngccnnagnntannnnnnggntnggagnttngggngnnnnctancnctatanccnnnnacnnaggggggggncnttntnnttccttttnctnctcnnngtgntnttctntgnccntttncncnntnncantctnnncctcacgtnnttnngttcnncccnnantncnnntncgnncatcctttnnttccnncccttncttcntntncaancactntnnatatgccntatatactcnnncncgncnacnctatnnctatcncctnnnntctncnctacnnnctcagtanttnnctctnnnngncntnctanctnctgngtctcncatcatatatncgcacgtnnncattanncctccagtcctnncntctnactctnannnangtctntccgtctnttcnanannctctntntnctatctnnattangtnacgnctctgnncncnttcacangagnntatgncncntttgtncatctcnntactcngcnncacgacttcnnatntctcnattnacangntcactgctaactcanctnnatntctctctncnnnagcgaacgatnntcgcannanacagcctntctgcnnananacntcgcncntcgtntagngcgatctnncagttnattcttnatcctcgtnttgtantatntntangaatacatnatcntncangcnncacttancanntnncatgacnactntgctctctgntancacanangctttcnngnctntcttacgannntgcnngcgcanatcntgactntctnatgtcgtctctcatnnatatttnntntacatanctnnctntctcctncantnttgnctanctcgntgattctctatatngctcactntncatatacanntntgnanacnattgtnactcaangtcntcgnnnannttctacgctcnctntgacnttccaatangganatntctntntcacnnctgtntatnccangtccttganccgannatanatcnnnatatcgacgacnngcnannnatantctctcagcgnatatncatcngnnctctaancncanactgctattcnantagnncncntntctctatncgcncctcctantacannattnggnntnnntcgctancnntntcgnctctnnttnnntatannntnnagctcacnnncnctgcgccatntntacntcatncnnngtctccatanacatntactntctatnaangtaccctntntctctcganancncnnatnnattgntcatnanatcanaaatntnnacntctctgatgacgcntctcantatactgncactcttcnnattattatnnagttcatgattctntctctcananaanntcngncnnnnctctctnaccatntcnancgntagtgncatgcanctanntcnccacntntatntgcgccaccatntactctatngatctccntganctatntnangnatnatctntncnccnnatntcnctgtntantcnancncanacatncgctctcatctanagtctcntangancncgnnacananctctcacanaagatnnntagcntattaatatganannttcctcnanntccttnnnnncctatntnatanncncagnanngactcncgacatntnatcatntctntcncnaacnctnttctannngtntnaatcntgnannctcgtantcnnnncanttcnntntcatgcacattgcgcannntctntncatcaaaacatactntatnctnagacgactnnagctncnatactctctcnnctnnanctngccnctnt

SEQ ID NO: 4768 - DNA, 1522 bp, Homo sapiens
  misc_feature (1)...(1522): n = A,T,C or G
ctnttaactnctaatncttcttcntggcnacggcncttantatgngccnctnaaaatcngaataggggtctnggggggnctactcnaccnnncncncnncgncctnatnannncctnaagnntgnctttccngcncttaantccncctctcaccnncntnnccgncgnggttttcncccctctnccctccttnccctatnctcttncccntccctctcctntccccccnttntcnatntncntccctcntnccntatctcncccctcccncccccccanccatccttttctnnctccccncnnctctcnntnccctcaccttttntccnntccnnnttctccctcacnnccncnantcctacatcnnctctcttcnccnttnttctcnccttnnacactctctatcatttatcctcccanntantnttnatcccnnnctacctnnntctacctttccncananntcttcatctttccctctcactccatanctnacctnatcccnacttctntaatctcttcnntcactnctcnctcactctcttntctctcnnccannnnttcacactntnntnnnctntcctntcnanntcnttcatnctcancnctcctctntnntntnttctctntntccccntacnncctccctatcnctctncncncatcnnactcctctctntnctcaccctcctnctctcnccntttatancacncttacnnctcncctnnncncnntctcactcactngctccatcnctcnttntatanatccccnctctntctgatctctcncctnacttccncanactctactnacttntctncactntctancctcttctcctcanctctcgananctntntcncanntcatntccnancttntataccancgncntctacctntntccctcacnaccttcctctcccttcgnatcanctcncnccntnctnctcacactnnctcactnactcatncntntnnatctcnncttantcncncncnctntcactctctcanatactntctnntctatcttctntcantcttntcttncncactatncactcccctctnnatcntacccctcaccatnctntnnaatccnctcagntacnntctacatcattnccntccatctcctgctnacantntcnccacatctctctctnnnnnccntntnactcctctcnccncctcctanctcatcacntccatntcnctctctctcnnactctacnctntccctcnactnntcanccccncttatccatctcnccnntctatctaccncactaactctctccctaccnnctnttcntccntntntctncttcacatcantctactactcctncctntnctctatnntcttnctcttctnaccattatcnccntcctcntnncctncncnntctatntcntntacatcctcccntcacttactctcacnncncttncctcctacctctctcaccctctactcntcnttntctcnncatactannctctcnccatcct

SEQ ID NO: 4769 - DNA, 1411 bp, Homo sapiens
  misc_feature (1)...(1411): n = A,T,C or G
ccncanccccccnnnnnaacccnnnnccnnnnnnccnnnccnnccnannnnnnnncannnancannannnnnnnncnnnnnnnnnnancnncnnncnnnnnnncncnnncnnnnnncntnnnnnnncnnnnncnnnncnnnncannnccccnnnnnnncccnnnnnncccnnnnnnnntnccancntannnntncnnancnncncnnnnnnnnnnnaaaaagaagaaggnnnnncnnnnnnnnnnnnnaaanagaaacnnacnnggggncgcgnngggnncncgnttttttcccttaaaaannaggacccttggggcgnacannngcctcacncatcgtcnncnganacacgagacnttgcggngnnngatttttnnaaanaccgantnccncatacnnacnacgcncnnncgnnnnaaannccnnannnangnangtannnnncgaaccccnnnnnaaancancncntnagnaagnnccanncagcactcgctgcggtacctncnncagccgncgnnccaatcaccnacngntnnnaccancnctcnangaccagctaaacctccananagccactctgancctcctacctntnnagaccacngaacnnattcnancaggacncannnncctcaacacnacnatcccctcactgnnccccctcccagacaaanncanntcntnnaagcgccatcncccnnnanancnnnnatccnanncannttcntanccccatantcccccacacaccccccngnncgnncantnacnnnaacanncnccgtagccccnntcctnaaccancctancatannacctctncnnnccctctctgcnccncacaacnnatnanctncaaacaanncnncancancacntaanncnncnncccacaacncccncgncgaacatncccnncacnnagnacccacacataananaccnncacccnactnatatatccacaancnaanccnntnnnnnccaanaanccccnnatcaacancacnacnaacanntcncnccntacnntatcnannatcannnncacccncnccttannannnnnnnntnacancgtanaaaacgnganaacnncannncnntctaacctnnaanccacnncncncacncnnantanccctccngnanncnnncanccnnacccnccttnanncnnnnccccttnaanacnantcancncnacanccnnncnnancgacncantaanncccaatcanctaaaacnnctctcncnnancnaacacatcnannacgancntccnacanatncacgancncnannaantcnacncananangcntcnacntatctnnaaacnnaannatnctcactancacacaaatctnncacnantaananccnncacgnaatcancaanataccncc

SEQ ID NO: 4770 - DNA, 1349 bp, Homo sapiens
  misc_feature (1)...(1349): n = A,T,C or G
ncctntaaaatnnnaaaactnnctttgggcnaaaacnnccccctcaaacatattcagacccccttaaaacatcagggannntatggggntcttntngggggccnntnnncantntcatatcnnatacanannccccntntctacacatcnctntctacttannanctctnnnctcatcnctgnnnnctatanntatctnctcccactcccctacttcacctctcncnncnnctcctcttaccanccntataccncancacccaacacncnaccnccnacctancacctatcanntcctcanattctccctntctccccttccctcctctcattcctcccncanctcnanaccncnnncacctcattctactacacncnccnctcccctctcccnnacnnctctccatcctncnccccnccnccttcccnnttntcnccctcctannncaacactccacnacaccncntcntctcctcactcctactcnctanccncannctcanctccanactntcctnacataactaccccactcntacnctctncatccacctcannntcacncatccactctcntntcnctctcttnnnacctcncatcnntctnacacctctnccccttctcnttctaccattcactcctactctnnctnnctcactctctcatttcntcnaccntncatcactcnttccnntaccctatcnctctntatctntcaccatatccncactcncgcacactctanctacnctctacctatactntcntctcatcactanatntntacntctctcnacncttannnctcnactacncactctcttctccactncancntanacacactccctactncacctcacatatntnctctcncnntcatnatacctctnnatntantcctcntctncnncacnntntncctcacacacactntctcacactnacnctctctctctcctntctcctcntcncnctatanacctnncactctcantcanccctactaccnctcttctctcctnctccnctntcttcnanatnnnccnctctacacnccacttacannaccacacatcactcctncaccctncatcnntcncttcactanntaccacnncactcncanatctccntntctntncntcnntnaccnctcaccatcntntcctnctcnctcaccntctnccactctcacctcnttcanaaccatactcnntntccactccncccttcanctcctccaccnacataccccnncaccncactnacncntccannccacattcnacacntccntcncncccttcctttcncntcctnccccctntcntncaccccttcccn

SEQ ID NO: 4771 - DNA, 791 bp, Homo sapiens
  misc_feature (1)...(791): n = A,T,C or G
gnntttagannnncngccncttgttctttttgcaggatccctcgattcgaattcggcacgaggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaanaagctgttgtcatttatgatttaataaaataattctaaaaaaaaaaaannnnnnaaaaaaactngagcctntanaactttagngagtccgnnttacntnnatcccggacctggntaaggataccattggntgaantttgggccaaacccccaannttgnaatgccntggnaaaaaaaatgccttnattttggggaaaattttggggaaggcnnttnggntttaatttnggnan

SEQ ID NO: 4772 - DNA, 750 bp, Homo sapiens
  misc_feature (1)...(750): n = A,T,C or G
cggtttnagaatcnancnctacttgttctttttgcaggatccctcgatgnngaattcggcacgaggntacntgcaatnaccatnntggnatcagtncactanngcctctcntagaaaaaaggggaccnagagacnggtnttcaccatntcgcccatgcnggtctcacactcctgagctcangccatccnactncctnnanctaccaaagtgnttccgtnanagncnaactcattttnattcaatggccatngnntctnacacncnattganatntnagcnnaccntannncagttntcanataccacntggcgnatnnanaaccccnggatgcnngaccntngtgaaccanatgctnanatgccattcaatcaggaagatgccaaaaatgnnctnnttattntaanataagtacttaagtnancantattcagaantgacnntctcatanggaagcntnnttatctncttnnatnannganattgttanaatcnttnccnntaatccaccttnatnnntacccntttgtttattaaggcaaaagattncnnttatccnnctannaatgcttcatgaaatcnaanntaatatttnttnaagctantntccaccattanttnnnnntgtacatttnntaatntgnaannccnatcttgtatnaaagaaccntaatnnccaannnttcctnaatnatgnttnnattccacctttanncnatatannccnaacttntcttntcttttnttccnc

SEQ ID NO: 4773 - DNA, 979 bp, Homo sapiens
  misc_feature (1)...(979): n = A,T,C or G
gtaccnattnatgtgctantctgctcnttctttntgcaatatcccatcgattcgaatnnggnacgagccnncctggtcnctgncaggattgacnnattgntagctntttctagannnngngnatggtggtgcatggccgagtcttagtatggtggagcggatcatgaaagcccagncacttgnnggacaactncaccatgggctatatganggccaaaaancacctggagatcaaccctgnccaccccattgtggagacgctgcgncagaaggctgaggccgncaagaatgataaggnagnnaaggtcctgntnntgctgctgctngaanccgnnctgttatcntctggctnnnccnntnaggntccccatacccactcnaaccgcatctatngcatgatcaagctanntctnngtattgntgantatnannctgncaccanangancccacnncttgcaactnctgatnagatcccntttntcnnnggcnacgangatncatttnntcctngaanaagtccatntagtcactttnccnntccnntntcnaaccctnttcttccctanancttacnttttccnnatcntncctcnncatctcgncnattcnccncatctncnccccntcctcatctccnntgnnnctatctnncccncccccnctcnnnttntctnattntacttctccctctctctcncntnnncattttctancctctcntncnntnctnttactnnnctcncntactacntcactcnnctccttactcttnncnantnnnnctctncctntnncctcnctcntccnntcactnancnctcntnntnnntcnntcnaccnctntnctcnanctcannnnctnnntncatcatcatannctntctcnccttanntnnctntcctcntctcncnctnttncncnnctcantctttctcnctctctntcnntctcnttnctntcaccntcctntctctct

SEQ ID NO: 4774 - DNA, 741 bp, Homo sapiens
  misc_feature (1)...(741): n = A,T,C or G
nntaaatcanctcttgnctttttgcaggatccctcgattcgngnnnangtcgagnacnttcntagggggcctnantctaatangngccttntgnctgtcatgatngncaattganaagnanttnantancncatttagaatctantgactagcctcctctctggtngctggtggcattnanggttcanaccanccntaantgctggtgctgtnnaanangtctcacgtggctgcntgtcntggctcatgcctgtnntcccaacattctnnnaggcccacncngtagaacngctngagnccangagtncagaatcagcctgcgcaacatnncaatactccntntcataaaaattcataaataacangtctcacgtgaccaanggctcctgaagctagaaccangtttggatacaagattgaagatccacangccantcttgcntctgagccntnnngcctantngngncatgtntnnnaattgntcanggcnagagcnnncnntntngcntnatacnggaangncngcttaattngcnnnnnttcagtccaaatnnnatactntngggacnntaacntgcnctatnctntatnnccagagactacngtcttantcatccannaaatgancgatngntnattattcccatggcacctntatnnaaatccagagttcttcgcagnctttnngctntttatatgtgtnccaaatnttaaaccntnataattattgggcntctgan

SEQ ID NO: 4775 - DNA, 711 bp, Homo sapiens
  misc_feature (1)...(711): n = A,T,C or G
aatcngctgcttgctactcgtgcngatccctcgattcgaattcggcacgagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcganagagagacctattttgcaatcagtgacattgatttttagattatttatttaaaattcctatnaagatcagccctttgtacagaaaaatgtgtctataaaaattatgtgttatt

SEQ ID NO: 4776 - DNA, 858 bp, Homo sapiens
  misc_feature (1)...(858): n = A,T,C or G
tccccattttgaatnnancnagctacttgttctttttgcaggatcccatctattngggngnannctttnttgnnaatncnggtacgnnnctatgnatcangactgnacttnggtanctnncttggcccntacagnngnaangaangatgggctggtggattggcccacctgggagcaacatggggcanggggagccctcaccctnagccanccagacgagtgggatttnccccagnacannatacccccttcacaaanggaccactnaagtgcttcattaagcaagtcctggatcctgtgcccnccaactgggtgagacaccccaatgggtcaccntacaccttatacaanagcattttactggcatnangtgggtgcccctcaangacanagatcccanagganngagtggggtctnatctttgctgttnttccatcactctttggtgacatnttcaggtntgggagggacccagattagtattggctttgaangaaattcccannnatantgcanntatncctnncataagatggtgcctanacttgnttataagngnataacantnangtctacaccnaacnttcancccntaaaaaattnccctancnaaaanncctcaatntttnaaagggtcnactgcttncnctttacaaggaatctnantgntggnntaacnanacnttctttgtaaanattganntaaacngggntnttngtatntatanntcctnctntaacnantcctntgatnaaangggnttctatntaatcggtgnttctgcatcntaaccttctcnaanaaanngtattctctnctaatntcanccncntttntaancnnngtcaanacgcgg

SEQ ID NO: 4777 - DNA, 999 bp, Homo sapiens
  misc_feature (1)...(999): n = A,T,C or G
ccncnncnnnnnnnnnnnnncnnnnnnnnannnannnnnnnnnnnnnnnnnncnnnnnnnnnnnnnnnnnannnnnnnnnnnnnnnnannnnnnnnannnnnnacnnnnncannnnnnnnannnnnnncnnagnnnnncncncgnnnnnnnnannanngngnacncnnnntanancnnnnnnncnnnnnnnnngnnnctgncnncncttttcnaaaagctggtcctcngcnactnnncaggcagcccnncgattcagaattcggcacgtaggccaagtatgcagtgtnaacggctgnnagnntcgagaaccngagtgtgngctctccntgnngaccnagancgangcgagagctccaagnanganatgantgngacctgcatggganaaggncaggnggatatcatggagagcgtgaananccggtctgaaanganacaggggtgccacccangtgccagagatgcgaagnaaccaatanagcaggggangggncaagngnnnancgaacngaagagcannnaacggnnnanangnnaaggagcacaatgangccctnatcgcccngagcnctcacgccnatnagggctcatncaaacngagcacccgctttcnnntgcccacaaaatngaattgantcaagncacgccngacangtgcnnanagccnngccattggaactcgtctcccccctangaatgctgcccttgcnannacccattgctatgctgctnaccanntcccncttgtattcctggggcccctcttatgnactgnaacgantcanccgtgactaggggtaaaaacgnangnggaaatgntatangaanttngcaccangnaatcatngcttatccatncccnaatgcatngntnaaanttcnacaactagtncgtcatagnacncntntggaatanttaggngaaactgtggcttatnaatngtccnanntggganaagggganccanatnaacttggctnaagcncgaatgtnncnn

SEQ ID NO: 4778 - DNA, 796 bp, Homo sapiens
  misc_feature (1)...(796): n = A,T,C or G
ggtgnagtnnatgtctaatnctntgnnngcgnttgctntcgatgcaggatcccatccgnngaagaagctgcagaagaaatgaagaaagtgatgatgatttanattttgatattgatttagaagacacaggaggagaccatcaaatgaattaatatcactgtattaaaagtctgccgggcacagtggctcacgcctgtaatcccaacactttgngaggccaaggagggtggatcncctgnggtcanganttcttnaccngcctggccaacatggcggaaccccatcttcactaatagtacaaaaaattagctgggccgtggtggctcatgcctgtaatcccagctactcaagaggcttgangcaggaggattgcttnaaccctgnaggcggagattgaagtgagctgagttcgtgccattacactccacctgggtgacanagtgagactctgtctcaaaaaaaatanaataaaaagtcnatttacaatgtgaaattctgacaccttttggctttgagtattttcccaaagatattttgaatccttantgaaggaaattnanaaaaaanctatgggaaaaattggacnaaatttcattncttgaacaatnttaaaattggggtattatttacctttaacantccaacntaaaccangaatttcagnaattggntgggnttggattaannaaacntaacctcatgttnaaaaattaaaaattcncattanttnccttggcctcnaanaaaantnntnacncanataaactccnngcccagnccttttcnnngccttttn

SEQ ID NO: 4779 - DNA, 712 bp, Homo sapiens
  misc_feature (1)...(712): n = A,T,C or G
cacaagctacttgttctttttgcaggatcccatcgattcgaattcgcggccgcggcgccaatgcattgggcccggtacccagcttttgttccctttagtgagggttaattgcgcgcttggcgtaatcatggtcatagctgtttnctgtgtgaaattgttatccgctcacaattccacacaacatacgagccgggagcataaagtgtnaagcctggggtgcctaatgagtgagctaactcacattaattgcgttgngctcactgnccgctttccagtcgggaaacctgtcgtgccagctgcattaatgaatcggncaacgcgcggngagaggcggtttgcgtattgggcgctnttccgctttctcgctcactgactcantgcnctcggtcgttcggctgnggcgagcggtatcaactnactcaaaggcggtaatacgggtattcacagaatnagggggataacgcaggaaagnacatgtnancaaaaggccngcaaaaggccagnaaccctgaaaaaggcccncgttgctggcgccatnnacatangcttcgaccccctgacagcatnacaaaantcgaccttaagtcngangtggcgaaacccgncaggactattnanatccagcgtttcccctggaacttcctaggcgctttctgtnccacctgcgttaccgatcctgtccgcttttncttnggaaantnngtttntatat

SEQ ID NO: 4780 - DNA, 712 bp, Homo sapiens; identical to SEQ ID NO: 4779
  misc_feature (1)...(712): n = A,T,C or G

SEQ ID NO: 4781 - DNA, 710 bp, Homo sapiens
atccagctcttgtctttgcaggatccctcgattcgtgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggcctggaaaccatgaccat

SEQ ID NO: 4782 - DNA, 705 bp, Homo sapiens
  misc_feature (1)...(705): n = A,T,C or G
tnctaggctcttgttcttttgcaggatccctcgattcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgatacccgagaatacagtaatggacaggcgggtgccatagaacatgtgagaaactacatttgnttgcatttctnctacccaccttttttgggaatgaatgttttggggaatggggctntnaccttaaggaaaaaaccnntgngnaatgctttaaaattttaaaactgatttaatattttatagtttaagtttaggtancttgncn

SEQ ID NO: 4783 - DNA, 733 bp, Homo sapiens
  misc_feature (1)...(733): n = A,T,C or G
tttgaatctgtctctctttnaaaccntnggctncttgatgtttntgcggatccctcgattgcgaatnntgcacgagatggtgtttnccctggaagctgagaanaatggggctttaatggaacaaatngctcangaagctgtttgtnatgcagnttattatggaaatggccaaaaactgtaatgtggatccaanagggtgttttcgtctatttttccagaangccnaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacanaatccagattatcttcagtattctatcagtacagctctctgcagcttaaactcggtggtacataaagaagatgatgaacccaaaatgatggacactgtataatttggttaagactgctgangccaagtgctattttgntacaacgaaaggaagaacttggctatttcntgacacttttatgggtgctgcactttattcttgngntngntttttgatggggagggaaagagnactgaaatgttttcgnaaatttttntttanngtgccngcttaggnntncttggtntngactctggtgtctngaataagangagntgntcccatatgtttngnnggnaanc

SEQ ID NO: 4784 - DNA, 709 bp, Homo sapiens
  misc_feature (1)...(709): n = A,T,C or G
tnaattcagctcttgttctttatgccgatccctcgattcgaattcggcacgaggccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgcccgaagtaactggctgtgcagaatgtat

SEQ ID NO: 4785 - DNA, 831 bp, Homo sapiens
  misc_feature (1)...(831): n = A,T,C or G
gnnngntgnccggncntttatacaatacaggctacttgttctttttgcagggatcccatcgattcgctgacctcctcctcagagaaagcactggccaaccagttcctggcccctggccgtgtgccaaccacagccagagagcgagtgcccgccacacagacggtgcatntgcantcacnngcgcggtacaccagcgagatgcggagtgagctactangcacggactctgcaatgtgagtcaccatgaacacaacatgacttgagggccaactgactaangacaagacatgtattcttgctgccccagggccttcatgccatggactccntgcnntgantnnaacangagcatcaccaaactacncntgnannaataccangactnatgataatggncccganangaancaaagctctgnacantggctnatacnttgtnatttncgtagctgaagcatgnggntcacctnnnntcangantttggngaccaacntnncnaactntnactntaacncatgncttttctaaannttnaaanttttaatnncgnntncaacnttcncaatntctggnnttcccnanntgctnngnnaggnaatctnncnntgantaaaantntttnanacncaanaaagntgnagggtttcaanntaagcttnaananntantncaaattnatactttntttngngntnnntantagnnnnnntnanaacnnntntntttcttantnatattatnatagcntaatataannttatantnatanncnatnnannnaacgtctananntttttatntcnntaaanatttcttttnnaaggntntcn

SEQ ID NO: 4786 - DNA, 793 bp, Homo sapiens
  misc_feature (1)...(793): n = A,T,C or G
tttnnnngntttannncattttgctactngttctttttgcaggatcccatcgattcggaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattanacaaacttacgaatgcttaacttntttacacagcataggtgaaatcatatttgggctattgtatactatgaacaatttgtaaatgtcttaatttgatgtaaataactctgaaacaagagaaaaggtttttaacttanagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaactttnccccctgtgtaaagttactatggtttgggggtacaacttcattctatagaatattaagtgggaagtgggtgaattctactttttatggttggggtggaccaatggctatcaagagtgacaaatnaaggttaanggatgattcccaaaaaaaaaaaa

SEQ ID NO: 4787 - DNA, 750 bp, Homo sapiens
  misc_feature (1)...(750): n = A,T,C or G
naatngcnaggctcntgctctntgngcaggancccatcgatncgaattcggcacggaggttatgagtggtcatngtgaaaatttggntgaatacagcaangtagcaagaaaatnncngncntatntactacanttaacctntatnaactgnnnngncatatgacatccaaatgttntatnatnacctggnaaanttantatagtntangatactaaaacagtatgnntacaaaagtgaactnnctgtgcanntntcacaggntttattcatgtgacactatatantgcctanngtcacntntcanccangttcntctnnagtgnaantnnntcnagngcatctngcacagatgctnnattgactanagaatgaatncnntgggcgnnnatacntgggctaactgcngnnatngatcattctananngcactnatgnanatanccccatanangccggacagacggtanacatacnnanngangcnccagatncttttannatgnatnattgagatttnaccagtctcatgtgccccgcgttntgtgttnnnctnanacangcngattnacnctgntctagncatcttgnctnnatcgngaaataatggctcctgcctccatnataatgtttaggagngaaatgnaannanttcgcgtgggcntgctngagtgcnaaaggcctttacnngttgngancnaantngggnagcnagttntcnccnnatngtacgctcccctnancaatntccg

SEQ ID NO: 4788 - DNA, 716 bp, Homo sapiens
  misc_feature (1)...(716): n = A,T,C or G
tgnnnttttgnttcnaatgcnngctcttgttctttttgcaggatcccatcgattcgcgcaaacttttcantctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgaaaaaaaaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcangttcanggggaggtgtgggangttttttaattcgnggccgcgcgccaatgcattgggcccggacccacttttggtccntt

SEQ ID NO: 4789 - DNA, 792 bp, Homo sapiens
  misc_feature (1)...(792): n = A,T,C or G
gnnnnnnnnnttttnaacgctngctacttgttctttttgcaggatcccatcgattcgaattcggcacgaggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggccttccacggatatgttgaagtaacaagcttgcctagagatgcagcaaatattttggtgatgggtgtggaaaattctgcaaaagaaggtgatcctggaacaatattcttcttcagggaaggagctgctg

SEQ ID NO: 4790 - DNA, 829 bp, Homo sapiens
  misc_feature (1)...(829): n = A,T,C or G
ggtggngggnngtanttctaatgctggnctctcngtctnnnncangancacncnncgggaatnctcannancncaccttcnagcnccttntgngagttctgatcanggnattacactcttttnatgggggcctgcctgtaagtgtagacatgcacactcagctgaccttactgntcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggngttcggatctattttaagatcgatggagttaattgcttcatgacagttcttatgaaacatgcttcnntatntccttgtgccaangtntcgnttacagatnttncnaaangaattnactctgcnaaatactgnaatgacnnntcnngtgngacntgttaggcgnaacgatanatttgngagntntnttccttttgtatngatttggnnttangatgcanganncnnattttcanccnagngtgnncatnaancctgacganaccnctanttntttttaanncctgtattaancacctagantgccccggngnccnaaataactnangncccacntcntntaaagaacttctgnnaaanntagttnagnccntccnggccnntaaantggggngatgnannaaaagncngaaaaccnntgtanccaccccntantggngcnnctnnnnctattnnntcnnnccgntnnctccntacatatcttnccctnaaatnctttgggcntcaacnaatccg

SEQ ID NO: 4791 - DNA, 747 bp, Homo sapiens
  misc_feature (1)...(747): n = A,T,C or G
nggnngttnatcnncntgncagctcttgttntttttgcaggatcccatcgattcgaattcggcacgagctcagtaacccaattactagtnccttttgaagagaccaggctgggaattggtagtaataataatagctgacatttaccaggggctacccacatgccaagcatcatgctaatcttgccaggtccttctgagtcantgtgaatggcangagcaccacatgttcctttntcttcagttcacacacattgagtgtcttcatgtgtaagtaacaacagagactgagggcatatgtattgngtaaaaaaaaattttgttactgggaaaatagccattactgggaaatagctttgttacagaaagtccttcatgtggctgggcacagtggctcacgcctggaatcccagcactttgggaggccaaggtgggtgggtcacctgaagtcangagtacaagaccagcctggccaacgtggtgaaactccgtctctactaaaaatacaaaaaaattagctgggcttggtggcatacacctgtgatcccatctactcgggangctgagggaggagaattgcttgaacccgggangcngacgttgtagtgcgccaaaattgtgcccttgcattncagcctaggcnngagagtgagactccgtctcaaaaaaaaaaaaaaggtgatttaattaaaaccagatgaacccttncatgatcacgtgctatgaattaaaacaanatnnnaaaaaact

SEQ ID NO: 4792 - DNA, 860 bp, Homo sapiens
  misc_feature (1)...(860): n = A,T,C or G
ctncttntnttntnnnatttttnanttntttanatnantntntttantttggtgtngntcnttnttctancctacacnctctttctctatctanancncggggnttnncaaaaatntggctcttctatnntntcngnctcntctatnatacacccantggcgaatccacatncagggggtctncaccaaagttccaacctccaaagtgaangactccgtggaacagcaagggnaggtgaagaantaataaaagagaaagaaangaanaacngcanaanaaaangaaaanagaaaagaaagaactaaagttagaaaaccaccaggaaaactcaaggaatcanaancctaanaagcgcaaaaagggacaggangctnaccttgaggctggtggggaggaagtccctgangccaatggctctgcagggaanaggagcnngaagaagaancatctcaaggacagcgccagtgattgaanangcacncntnggcgcanggaataggaanccngangcactnggaatttgaaacacattctannaagaaaaagatgaanctcccaanancatnctganggccgngaaccanangacnatgantgcttcctgcaaaaggttaattcaactggtaatggaactatttnaaagcaaattctgaaaccangncccccagacaatgnaaatnaccattcnataaagcctnaggnaaaaaatgttttatgctccanttcttaccacaanntgacatnattgagccatnnaccatattcccnaatgatggaaacttccctangtncattcnttttaacnaagaaaattcaatccnannaaccccttaacctttnaannttatttanaaggnnn

SEQ ID NO: 4793 - DNA, 1222 bp, Homo sapiens
  misc_feature (1)...(1222): n = A,T,C or G
gnnntttttnccctnaaaaaatgggcccttgggggtttttcccttaaaaattggncctttgggggttttccnnaaaatnnncctttgggntntaannaccgngnccgttttttcgngnnanaannngatnntctnntncnnctnnnnnnnannnancnnnnnntncanntctatnncnncnnnnannanntatcnnnnnactctnntcaattcnnnnnnnactnnnntatnnnnatnnancnnnntgnnnannnnnntntcatcntcncnnantnncnctatnncnnnatctnannctctcntnnnnatanacctgncataanactnnnnnncatagtcncttnacancttnttatancnctnatacacnatctnttctaantctantnnatnatanacntccatcatnattnnntacttncanaccccnctnnccctacnctnanncntcactcccnnccnnatctntctctnctatnnnatcantntnnnnccanccactnnnacnnnntactantctaccnnncttnnatctcnatnnatcatanccatncntccncnccacnnttcncctnttaacnnntntatntcaatanaatnnnctnancnattacntcnnctcncntcttcattttnnttatctnctcattaannnnnnctccnncntcanntnnccntntnntactcnncnatcccntaantnctccncaatcatactcatcntctccatanatactcanatcctatacnnactatcanctanntcttcnantatattnttcattnttacnatccctctctccntcanntntnaanacnncnanntacncttanatctatntntanatacantcnnntnnncncaatntcanatnttctatcatnctcntaannatcctnnntntnnntataatcctancnanccacannnnctccnntatntnnnnacacatntatacncnactnannttctcnntcctnatnacatancccacnctntncatacantcntcncatntcntnnnttntattnttcanctantaacatantnanantcgtactnnnnanncancactnccctcnttatattcatcnatctntacataccatctannnannnacnnttcacnnatncntctncttnaattacanncacnctcnntcatanntcgnntatatatcactctntncnanatccactntntctntnntctccncccg

SEQ ID NO: 4794 - DNA, 1068 bp, Homo sapiens
  misc_feature (1)...(1068): n = A,T,C or G
ggngcctttnaaaatacccngnttnnanacgcntngttacacncnctagcttaaaagggggnggaaccctatggntgcattgactgtggcaaggccttnagccnagaagttttgccttgtagcacatcagggtatatcatacagggaaagactnccttngtatgtccngaangngggcaaccctgntcacagaagtcaggactcattagacatcangaaaatncactcaggagagaaaccctatnaatgcanngactgtgggaaagccttncttncaaagacaangctcantgtcannacagaacnnacacgggagagagaccctatgnctgngatgagtgtgagaaagctnncttctatatgtcntgccnttgttaaacatnagcagaatacactcannggaagaaacncnnggngattcannngaangnggaaatntcctgaccacanncanggtncntntcnnnnagttcctaantagaacaatggngcnanngnggtanaaaggcccctgntagnanatannntnaanaccttggtnggcnnnnatggatnnggncnngtggggtnaatactgatgtgnatntctcnggntnancgaccantatnttngcatntnttcctattggnagnaatacctactntntaatntcnnnatntnctgcggganntannnttntttagcatctnctatccataannnncnaaatngatcatcatatnntcnatgnnctcatctngtctnacactnttgggtngccatctgctnnagacatnnnactntaanctntaaattnatcgctnantannacccanngtgntnaccagcngtnacnncnngctnctcngtnnngtatantntcacnatcatantcantgaatntannganacgngcatcttntnannctgcctcnnactctatcanaatnaagtnncncgaggnactcanantnactntcnnntnnttcncanaatgtatcatnnnctcnnnanantattttgantgcanatcatngnanacntatgaanccnaatcatgtntattncnanngcnttacttntnancg

SEQ ID NO: 4795 - DNA, 816 bp, Homo sapiens
  misc_feature (1)...(816): n = A,T,C or G
tttctaaatngcttgggtttcnaaatcccttggttgacgccctcgcctaanntggcgtgnnantgcccncgattcgctgncaagtctggaantcatattggagcctgngtngactgaaaactcagcangagttgatgttaaagtcttgggtctgaaattngtngggcaggagattaggctggaaactcaggcagaatttctgtgttacaatcttgaggcataattcttctccaaaaaaatctccatttttttctcttaaagccttggatgagccttggatgattggatgaggactacccacattatctagggtaatctcctttgcttaaagtaaactcactgtgttaatcacatcaacaaaataccttcacagctacatgtagtgtttgaccaaacaactaggcaccatagcctagccacataaaattactatcattatactttgtcttatcacatacttctaccttggaagggatatttcccagttggtatagctacaaaacagaggcagatcatttagcctgcattngattngtantgaaaaataagcctttggtgngtttaaccactgaaaatgtttgcggcctattagtantngcacaacttatcctatnctggccaaacatagaatgctttcggtttgcaaggtaacangatcccctttacagntgtacnaaaaatnancnntaaaaaaactngagccctntagaacntnntagtggagtcgganttaacgttngancccagaccntggattanggatncattggatggagtttggacataccaccancttggaatggcnantgaaaaaaa

SEQ ID NO: 4796 - DNA, 1094 bp, Homo sapiens
  misc_feature (1)...(1094): n = A,T,C or G
cnnncaaanacnnnnnnnaannnanaacaacgggggcgncncnanttcaaanctggnaaacnnntccnncacagncnacgaacgaaanggcacnagcnngcnaggaaaccgccncngcncagcaaccgaaggccaggnaattttnaanatcggngngggaggacagngggggncaatatgggcgggantnnncttcaaacangnaaaccntnccnngnggcggggganaccncggncaccatggannaantncnacaanaccgnggggaagacnggntatgcaggcnccgccataaanccccccctactaaggcnncanggancaccaacagntggnggccancaaaagcntntaanaacaanacctnacaanntcnncancnntttngcntatcccaccacnggganacangncaacggtggacnctcnaacaannaaaatnngaaaaacaaatctccccaanaatnggggggngaaccanngnnangnnanctnnaaccanaccgtcntgnaacnngcnccaatacaangggnngnangnngncanaacangcnnngnaccngcacgnaaggnggnnggcnngnatcacancaaacagacaatatccacggcgnaccccnnncacncnntnaacgggacccngagtacacacangcacgaangcccnnccngncccacncccctgnaancgagaaaacnaangccnggatacaaaaaaccccnaaccagccggncntnnccccccaacnngannaaagnaacanaccncacannngccnnngacaaancncnacaananngggnaaacaaacnctatggganatccccctanggnangcngacccgnnaaacggannancacaanctaaacaancngtncacgccaaaaaaaacngcccaaggccccatcacngaanggaaaacncnanacggnnannanagncnccntaannaaannccncnncnngnncaatcncccattcgaaaancncncnctnccgcnaannnggaanacnntcaaaaccccccgannncgacnntatncagnaacannaaanntggtgtnaccnncccnnncctaananatcnncc

SEQ ID NO: 4797 - DNA, 930 bp, Homo sapiens
  misc_feature (1)...(930): n = A,T,C or G
ttttgctaaccgctggnctactcgntctctnngcaggatcccatcgattcgaattcggcacgaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccanaatctacgtctaaactgcagaagtttacaagctggttcatggggcggnngcccgagtacacagaccccaaggtggtggctcanggtgaaggcccgnnaanggtgtgtttgnggcccaaccnacnccaatagctggngggcaacacagaatagntnctgtataataatagtctcattttcanagaaanannttnntattccnctcttnnttcctaatcncnantncttattantntntaccntcnnnnnnccncctcatttncnctntttcattttatcnttatcttatnnnnntcnancctactnntattactcctnncctnnantctctatncctacnaccttntaatacctncttantctanacttcncnctctntaccntctctctcatnctntnnctactctctccctctcttctnctccatattattcttctctnnnantctntcttnttntctnctattancntncctntctntntctactatatcatcatntnctntcnanctnanntntctatctcntacntactcanacaac

SEQ ID NO: 4798 - DNA, 801 bp, Homo sapiens
  misc_feature (1)...(801): n = A,T,C or G
aaaaagncaggcnacntgnagacanaagancccanngaagaancncaggaaaagcccacnccgaaggggnanacggacgagccnaggcaaaggncannaagaacagngatttacanacgatntgcccngaancncnnggggngaaancagnggcngggccaccagnaaagaaacnagnncgcccaggncnnngangnanacnanaaacgnaagangangagnnaggggggaancangacaggagaggcaaaannaaaagnnanananagnggcnagncggacngaagaaanaaacaaggggngaagnacangaacnaagaaanagcaaaganaacnnaaagngaacaannccagcgccnagcannanccnaggangcacanaaaacagcaccaagaagacngnannagcangagagnngaagaganggcgcncacggggacacacnaggcaaacgcganaagcagnacnggncnaggngncgcgaagnanaagagacncaaggggangagagcanaagggaacgggnngcaggaagaagacaangnaacncaggaacgaaaaaggganncagaaagccggagaanaacacggngaganagnaccaaaggcnaanaaggngacaangggcaagagacananaccangnnggacnnaagangcnacannaggnaaaacannagangaaanaggggaacangaangnaaaagngaaannngggggaaaagancaaacnaaacagaaaacgggnnnggaaaaannacaanngaanaacanggngncaannggaannaaaggggan

SEQ ID NO: 4799 - DNA, 813 bp, Homo sapiens
  misc_feature (1)...(813): n = A,T,C or G
gnnnttttnaannncgttggtttcnatgtancatttacnagntctttttgcaggatcccatcgatcgcaggtccacagccgaggtcgancancggcacagcgaggtcggcagcggcncagcgaggtcggcagttggcacagcgaggtcggcagcggcagcgaaggtcggcagcggcncancgaggtcggcaancggcagcnaaggtcggcagcgggcccccgctgtgctcttccgcggactctgaatcatggcnaaccacnggccacgatggcgacctcggctcggcgcgaaagcggctgctcaaaanaggaagacatgactaaaagtggaattcgagaccagctaagaagtggatgtgacccccacgttcgacaccatgggcctgcgggaggacctgctgcnggcatctacgcttacggttttgaaaaaccatcagcaatccagcaacgagcaatcaagcagatcatcaaanggagagatgtcatcgcacagtctcagtccggccaggaaaaacagccaccttcagtatctcagtcctncantgtttgggatattcaagttcgtgaaactcaagctttgatcttggctccacaagaaanttggctgtgccagatncataaggggcttcttgcttntcggtgactacatgaatgtccantgccatgcctgcattgganggacccaatttttggccaaggacatcanggaacctgggtttacggacaacatgttttcncgggcacttccaaggccgtgtttttganatnatccttncaaaaaaccctaanggacacctgctnttnaaaaatttg

SEQ ID NO: 4800 - DNA, 776 bp, Homo sapiens
  misc_feature (1)...(776): n = A,T,C or G
ttnaatncttggcttttcanaatngctggangactngttctttntgnangaccgcacgagcacgaatncggcacgaggtcactntgnaacccagactgggagtgcancggtgtggncatagggnnctgngcctggnanngtntgntcgagntgtnatcncnantttgnttttgggtctgtagcttaannatgcngannnangatgcnnnnanngnttntgtnaganatggggtntancnagtttnnncnancngnnttcaattncatgggctcaantgaaccnctgcnntggnctnctnantatnngggactnncagacatgngnnannagtnctggtggcanatctcaatattanaggtaatatgnnatagtgatatcnatgacngtaccatttgnntcaaaatgtgaaaganataccgctgaagttantatgtnctnccttccaantcnagccgccatntcnntcnactcngcnantatgtcgactcanaatgaatgatngacatttnngntantncngcatcctatcnagtgctattatnnctananatntcnataattnnctngnccctnnancctacanncntngtcgnatgtntatccnncttnntgganctttgaaannttcgatagggggaacntgatnagngcagtntnacanaatgnttgcnanttntnantcggaaanatcnaattngggnagctgntaaacancnngggcntacctttntaatgtncnngggtntntaantcaaccnggntncngaaaaanaac

SEQ ID NO: 4801 - DNA, 720 bp, Homo sapiens
  misc_feature (1)...(720): n = A,T,C or G
tnnnnnttttnaantcaatnctggctctcgttctttntgcaggatccctcgattcgaattcggcacgagatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaaattgtccaatcacaagaaaataatggcaataattatcaaaacttt

SEQ ID NO: 4802 - DNA, 1117 bp, Homo sapiens
  misc_feature (1)...(1117): n = A,T,C or G
atnncnnnnnnancncatntnctantcctnacnantnnncttncncntnnnntnntnctnananttggnatntagnggnattcnaatncccagctntngnnctntttgcaggatcccatcgattcgaatnnggcacgaggaggaattcagctatcagctctcttcatgagtggagtagacatggccttgtttgcaaatgangnntgcngacaaaccaatcccctgggaacactgttgtccttggatgtattttgatgggaagctcttccaatccaaactcctcaaagccagccgggaaaagaccccactcattgacctctgtgatggtcaagctgatcaggctgccaaggtagagaagatgcnccatancgtcctcnaaagggctcagcttctncaggcanagccacanncttncctttnccgncgtcacctgcnctgctcttttacccctgtctntgnntacccccntnnactttttannccnnntnccaacccctnttaatggcncnnngncantaatgctntttncattncnnttctnttngnncttnntctcctangncccccctcattatngcgnnaaanncacngactatnttnntctnatgggcntccctttaaccnccnctgnncacactnctcnntcntantntnnatntntctncnatnntanncnnctcaatatcntcnccatcacnntatctatcctcnngtncctntctnnctnanttnnnatcanattttctatttnncnactcatntctctacnatcntantntatnnntatcaatctcanantanactantatntcantntnctacannatataatatnctcttttnatntntntnntnatcatntanatnatctntcntnnatanctacatctctctntctnnncatntcatntagatacanntanatntagntaattatannncttnttcttanttncnnnnnttcncntntcatcnctctnnnncgtannnctctccnntcattcnattcatacttcnnattgatnatncantannccatcataatntcacntccctcatancttnttctncaanntatnnanattctcnatatttcnttatctatanancnttgccn

SEQ ID NO: 4803 - DNA, 781 bp, Homo sapiens
  misc_feature (1)...(781): n = A,T,C or G
ttcaaatngnaggctctngttctttttgcaggatcccatcgattcggnagantcccatntctnnctgctgacgagggacctgctttggtgagtncgggaaggcccagggagtngnggcatgcnggctnctnattcactatggggnttcgccntggacacgtantcaantgcgcatgctgctgcccatgtntncctgccccacttcacccanttgggggctgctcaagggtngnnnggcntcngtggctggaggccagtatttanacaaggctctgtacatgacacncaactgtgctnanagtnccttcnctcngactacaccnatgntttnacagtnccctnntgnnnnntcntnttactacagtgcnanaacccnaatgancntttnnttcctgctnnatgccnncnnnantnnnngacnttntgttaatgttaacnaagtgtgtacactttaaanccacatattgtatggtntcctgtannatnangtgccngaacatgnacatttcgatanccanagattagattannggttntcatanggctgggggaannggcatancttagtgattggtaatgatntgggatttnttttgggaatgaatgaaaatattctaaaattngttgggnnnttatccnaattctacgaaatattnttaaaaaacccacntgaatttgnctactttaagnagagtgaaatttnatgtccttgttcctcnaattaagcttgngnaaaaagatcgtaaaancnngatnnnaantttctntnanntngnnctnt

SEQ ID NO: 4804 - DNA, 753 bp, Homo sapiens
  misc_feature (1)...(753): n = A,T,C or G
aagctcttgttctttttgcaggatcccatcgattcgaattcggcacgagaaggctgagacanganaatgncntnaatngnngaggcagagcttgcagtcnnttcgagatcacnccactgnactncaaccngngagacanantnngactccntctnatacnatgngaaccctaaaatatgggntttntgcacattccagatctcaanancntgattctaantgaaagatggcaatatnccatcagaccaggtnttntctagntccntnttacgaaatgtccacaaatggcaggatcttcagantcctagtnactgctantgntncnaggaatntttntnnggngactannatgtnctaaanctnantggaggtgatggtnnaacnantnggtcactncactaagaatcattnnatngnnactctatntgggcanatantatngcnaatgtaccttaatnanatcatgcttnaangtcaattaatccactcatgaanttnancctctananctnnagtgannngtattacgnncatnccnacttgntnagatccttggatgantatcggactaacccntnatcttatgcagnntacaaaaatgccttttnnagggnaaatntgcgatgctatntgcnttatccntaaccatttgtacnntcccatttaacagggttaccnnccatccaattggcaatngattttatggnttcntggtttncnggggttngatttgngaangtttnnttantttcc

SEQ ID NO: 4805 - DNA, 740 bp, Homo sapiens
  misc_feature (1)...(740): n = A,T,C or G
agggnnnnnttttnagatacagctacttgttctttttgcaggatcccatcgattcgaattcggcacgaggtttgatcatnggncaaggtnctggngagaactgcctntgnggntagctgattnnggggtccttcatatgaacganctgnntggagcactcacaggactcacccgggtacnaagattccaacangatgatgctnacatattctgtgccatggancagattgaagatgaaataaaaggttgntnggattttntacntacggntatagcgtattnggatnttcttttaaactaaacctttntactcncccggaaaaattccttggagatatngaagnatgggatcaagctgagaaacaacttgaaaacagtctgaatgaattnggtgaaaagtggganttaaactctggagatgganctttctatggcccaaagattgacatacanattaaagatgcaattgggcggnaccaccagtgtgcaaccatccagctggatttccagtngcccattanatttaatcttacttatgtaagccatgatggtgatgatnagaaaaggccagtgattgttcattgagccatcttgggatcagtggnaagaatgattgctatgctnacangaaaactattggnggcaaatgggccttttngctgtccctttgncaggtaatggtagttccagtnggacccaactgtgatgaatttcccaaaangacnacaccattncacgat

SEQ ID NO: 4806 - DNA, 824 bp, Homo sapiens
  misc_feature (1)...(824): n = A,T,C or G
gncnctttcaacttcgccccttttnaaacccgttgttcaaatcctcgtttcaancccntctgcaggatcccatcgattcgaancngcacgagggggnnnnncgtggcnnattgcgngcagtacccttcnagcncngngnaaagtgcagncanncgtaacacatgcggcanacngcanngagcanaatgntaatgnccacttcttgantcatnccagaactcccttaagcccacaagtttgtnnngngnnaggtcaantctaggaacncngccgngnaacnggtntctcaatnnagncatccttanttnctgcatanacangagngttcttaaaacnnctccngtaaagcaagncatntctganntncctgaggatcattgctcccgnatacngntgntggggtgagccttcaggnagangggaacagaatnnngtactagggtcganagtcaananactaaggcncttnancaacatctcagagcanannatttgnggagcccntggaacgntactgggnaatttantcagtgngcatttntnaagactgggnccagggntggantnatctnttggcgangggnncntagngcctcancacaacactgngcnagcccnggacttagnaaacccctgcanaaactggnnnaannggcctnttaaaantnccccanangtnnaccccnnaagaagcncggnaagccccnaaactnccaaaccaaccnctntctttcctcnncnaantnnacancntgggggtntgcnttggtnnnaaatngnnccnanaantgcaccagntcnacnntagtcnnggggnacggnnc

SEQ ID NO: 4807 - DNA, 745 bp, Homo sapiens
  misc_feature (1)...(745): n = A,T,C or G
tntagatacagctcttgttctttttgcaggatccctcgattcgaattcggcacgagattcctttcatggtacagtatttaccccaagtcatgattaaatatctgtttatatatttctttattggattatttgtttatttttctctctctagactgcaagctccttgagcagaccatgtttattttgtctaccacaggtgctcaataaatatttttgactatttattacatgagaaggtttccatgcaaacacccattgaatacgattgaacttgaaccctaagagatgggctgtgacctttgttgccctcaaactaatcaaaggggagtgatattcaccatccagaatctagaataacttanaccttgtgggccaggagctagctacccatatgataatacaagagctctcagagaaatcatggaagttttgagcaatctctctctccctttgctaatttacttttcaaaactgaagtataatgggaataacttccccacctctcaaatgtcagcatgctctgaaatttcatgttctctcaggcgagccgattcatgttttccattccaccctcttctactgggctctctatgccctttctacagtctcgnttnttttaccctgggcccttttncctttggggctcttgattgaaaaaattgctgaactgtagctttnggaagtttaancttttgagaacccgtagantgatttcagttcttaggaaaaataaaancccgttgnn

SEQ ID NO: 4808 - DNA, 713 bp, Homo sapiens
  misc_feature (1)...(713): n = A,T,C or G
tnnnncttnaaatnganagctacttgttctttttgcaggatcccatcgattcgctttttaacaatctggggctgtgttgcttctatgcccagcagtatgatatgactctgacctcatttgaacgtgccctttctttggctgaaaatgaagaagaggcagctgatgtctggtacaacttgggacatgtagctgtggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattaagttaangtgacacataagggtgacacagaatgtgtaatgcaaatttcatagtaatagtaactttataaaataatatta

SEQ ID NO: 4809 - DNA, 765 bp, Homo sapiens
  misc_feature (1)...(765): n = A,T,C or G
gnnggnnnnnnnnttgcnaatgctaggctacttgttctttttgcaggatcccatcgattcgaattcggcacgaggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgntattggtagttctgtaaaggaaactgtggaatcgaattggcagtggagtcataaatctatttactgagtgtggcttccaagaaaatgttgcaattcaaaatgcctaaagtctgtgatttattnggagatttgggagattcttaaataatattttttaaaaaacttccatgccaacnttcttggnttaaatggtttggcaacctnccccttgatnaaaaaaattaaaaccaggcccaaatggtnctcaaatttaaaatct

SEQ ID NO: 4810 - DNA, 800 bp, Homo sapiens
  misc_feature (1)...(800): n = A,T,C or G
aananggccnggcnncnnggnnnngccnncgnaagccctttgnangnaacccctctgggaangcccccancggcggancccngcgccgnggnacncggcacgnggcagacnanacnanaggttgacgngccnttttcgancaggngacgcacnacncnggcnggggganccccangccgggcagnncggccgggggcccggccacgaagaacgcgggccngggcgccncgaccnnggccgcagataccancaacgggcagggggcgnnctnnnggcccagcaagaagggcgaaaangaggccgacggntgccnggcgcggcaccacgantggcacccnngancggggacacgcgagagagcangtgggggccgcgacacaggggagacggcggagccgngggacanggggngagaaccacagncncnnagcncgccagcgccggnaacagggcnggnctccangcccgnaggcnncgacncgngcaaaacngcnggccnaccggncnccacantgaaagacnggaggagaacgggganngaangacngggngcangagggntgagnnggccaacanggngcnaacaaangnnccacnacgcccgngngganggcagngncagcggnggagaaggaggaccncaaaggcgacggngcagggacgcacngggnaaaacccccaanaggcanggaggggacnnggcgnaagggccggggaggnnngnaaggggggcccggnngccngggccccnngnacccnnaaggcccncnngggggggcaaananngcccnnnngaacna

SEQ ID NO: 4811 - DNA, 741 bp, Homo sapiens
  misc_feature (1)...(741): n = A,T,C or G
ngttgatcaagctcttgttctttttgcaggatcccatcgattcgaattcggcacgagcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgttgccagaaaattcagctcctttaatcgaatttgcaaatgtgtccaaggtattttattacttctcatgttaaaacaacatttgaagaatc

SEQ ID NO: 4812 - DNA, 817 bp, Homo sapiens
  misc_feature (1)...(817): n = A,T,C or G
aaatntacagtttcnngaccnttgggcaggcatcccatcgattcgaatncggcacgnaggatntactggccnattggaatcnnnaacctganttagaaaggctcaacgagancangctntcagggctgctaaggaagcaaaaaaggctaagcaagcatctaaaaagactgcaatggctgctgctaaggcacctacaaaggcagcacctacncaaaanattgtgaagcctgtgaaagtttcaggtntcaatgtntactcangatggaatgatnnangcatctggctcacgntgaagggctcgcntnaccnatnacactgtcgtcctgcancacanncncagcatgnntgtnctntgcttcaaagnctganaanctcttcatntcnatttgnntnacacnctgcntgacctngccctctnatacnacntgtttctaacccgnacntnttccntctatnntnttntcctngcnaangnncatatgngccnagncngcncgngcctcacatctcgtgctcntggcnncttntgctgcctgaaactcccttgncttacgtntgtctcntngggtangccctntcnctntttcnagacttggntcnaangtgtacaacatntantgtnnangcctttctnnaggatcanctaantgnntggacacnattantaagncttnctnttaantacttnnnattcaattngctccttcatacattcntgntaaattgttccctanctggnnnagcaattanatngcattnttantagtnnngnntcccntntntgnttaatgcctcncttatngggcggtnngggtcg

SEQ ID NO: 4813 - DNA, 1359 bp, Homo sapiens
  misc_feature (1)...(1359): n = A,T,C or G
ttngnnaaaantcnnctanaatcnactttntggnnatacttcggtcntatanctaganganaaggggnatcccccantcngnatctcggnacntnntangctaatcatnagctatnnnattntttacncatgnattctactannnntcatntataataacnncctaaatnantcnnaatannaagnntnctnnggganatantctnnnnatnntngantcnannnnanntatntcaattancnccataactaanatantatntatntnnatnttanttntactantnnatannacttannnantactnnnnatacnannatatannananacnacnnnnttnttnntntttctntaaatcaannnnnntcntatattactttncnnattntnnatnatnntnnatnnnatananncnnnttattntcnnnnatattcnntatttnnannataatcnctaatcnaatannatnataacnnncctatcatacaataagnaatacnantcctnnnnnncnnnctanctatcttnnttcnnnntnatannttttntgatnncnnatcantntnaatacctntatactnatatnttatcatntnnannntnannncaantatattnatnanacncaaactactcnactntntcnanttaancaaananntantccatatntctncannncnntgantattananagatctntnactntatanccanannnnattgnncanatanatatcantactacatataantctacnntnactnntaactnanaannnnactatnactcgattntctatncacttatnncannactactacncataacancagtntntcgcntacntatancgagtnatctnnttttaaatntatatnacatactcnanaatancnatcnatnattactanacatatnatcaactatatangtnnagtanaaatcatcttttnaattnntaactaacagnntatnaactanatgnatatnaatacatanantatncaaactcntnnctcacancgttataaaataaccntataanattgntntatacagnanatacttatnaacttngnattntatatntcncntctaannataccattataatgcnatnacactatntaatactatanangctanatcgtnnnatgnntctcncncttatntacnactgcgantcannnncntnttatcgntctcatncgattntaccnancatanatatacccatattatantantntgtnannctntatatatntatatnatactnannttngnnatntcatatntnantctcncagatnntacanntntnatantatnaatgcctatantacatncg

SEQ ID NO: 4814 - DNA, 858 bp, Homo sapiens
  misc_feature (1)...(858): n = A,T,C or G
cttgaattcccctaatnaaaccgtttggnaagcccnatnnctntaggnnnncnntgcgntnacgatncgncacgagggnnccactgaccacnantatgtcgnacntttnacaanggcctgaactaacntnaanaatnncaaancatcnnaacggancggccctgcctnaacngacgacgnntcccnttgagnnatagccnngccccnacttaactgagtnattaaccntgtatnntntncttcngnnggctcagaagctgatngantnancncnatcacgaccatcgancttgctcnccnnagancnncccagtnaggntnattnagnattnnctnccnnnancntatnanaatggccgctcccttgatcnancnatcngtgactctcatntactggactcatnccacctgcacccangcgnatntaaanatccccatagntcacnnnaatnataanacataaattaggatacanacctgattganatgttnnagctgaacaggntntaccnnctgnannctcttgggngttaactatggatatgaacntcactttgaaaactggganncnnaacggggattncttaaatnccttnttgctataggcnaatanttnccgggagaggntggagtatcnnggatgaancaattcanctttactgaanaaagtgggcncggnctngaatccatagggnaaaaccanttgttaanattatngggttccaacgnaanncctgagntaacnttccaaanggnttgnaagantttgggaaggcntgaatgggancaangggggctcccnatccaaanaaattgtcaantttcaagtncctnggccctttntnaaacnntngaant

SEQ ID NO: 4815 - DNA, 716 bp, Homo sapiens; identical to SEQ ID NO: 4788
  misc_feature (1)...(716): n = A,T,C or G

SEQ ID NO: 4816 - DNA, 767 bp, Homo sapiens
  misc_feature (1)...(767): n = A,T,C or G
naancnatagttcntgtnctttttgcaggatccctcgattcgantgcgnctnaagnancngcncaggnctannctcaccccattactggctgntgttctatgnaggtctnatganggnanctgacnnagaccgtgnnagtaacnttggactctnctncantgnactaagaananacnaatgtgggcnngccatntgcccnnctcgtntgancacancnannnaagagnctccagcatggcaattgcnattcacccngaatgctgtncatgaagngaactnngttcnngngacggcattccnacctgngccnatgcccatgacnaggantcnactgganntcnagaannntgctnntgngcctcntnaanggcnnntgtatngctcaccatggagccctngnggncnttggacntnanntactatgacaggccanancactgactgaccancntngatgacggctcntgtntacctatgaattganntgcatnananctngagngatcaaagttacnanntggtacacctctnnctcagngatttctcaggtnnctcgatntcaanncttaatatntacanngctaattgcacttagaccctgncacgttctngatgtnanacntccttgacnnnatngtnacatntttnttcatgncttaaaagtnaattggtngcanagtttctttcnatnccggatgctctgctnttacncaangatacgngattnaatgtnaangntcgtcaggaagnntttantgaacttnct

SEQ ID NO: 4817 - DNA, 1154 bp, Homo sapiens
  misc_feature (1)...(1154): n = A,T,C or G
ngggggagggntgaggtgtaaannnnctcntanntatttaccaagccttactntgggtttctttttttgggccaggggaattccccattcgnatttggnggaaatttcgggcnaccgaaaggcagcaagggtntntggtnccacttgggggttgccaaaggggcttaaanaatgncttccaagtttaaaaaggccagngcaaaaattaaccgtnggggttcgngcttggaaaaaaaataccgtggtcaattttcttaaaggttgtggatttatttggcaaagnttnaaanaaatggaaattggatgnttttccaacnaaantaaggggttatttggtaaatttcaagggggtattagccacaccaatttttaaatggtaaagcccnaanaaaggatggttttgtnaccacgtttncnaaanaaaaattagtnacctggtatccanntcccaagttggtcccacttttcncttcctaaacctttccttggccctaccgccaacnagcaccactttananattancnttgccaccgaatttncctngaagccacngggaaaagggaataccttttacttggaccctggtttcaccgaaanccgaccttntttagaccctnaatgaacccttattttcactngggttnantaanacctttgtcntttggggccaggnccttntttcaaccctnggaatgcttnaagggtnggaaaactagganttacccnaacccttggcccctttcantngnaantnnacataccccatttggttngtgctacctttngggnattaccccattnctttannccccngnantnccanggngtnccatcantggttcctangtaaaatnncggaaactttcttaannggnanggacttgaanggncanagnangaaatttngcggtagaataaccctnnnaaanngtcnnaatntgnttaanntncttttaaccttgaaaaatcntagcncncacttggttanctntttgccccntttnncccnncnnnannnttggcactttccgntattcccctnanaaaatttaccngctngacatatnttnactcccngtgccnttnggttnanaccaccacccntgntagtntcccaaacttcntncctcatgctacntctacggggaggtct

SEQ ID NO: 4818 - DNA, 766 bp, Homo sapiens
  misc_feature (1)...(766): n = A,T,C or G
ttnnnnnnnngtnntttaagntacaggntacaanncctnggctactngttctttctgcaggaanccatgcgcntngcaatgctgancnagggctntnntcatgtatccactggnttctgccncccaaantgctngactgcagnngtgtgatcatggctnactgcnnccttgacctcctgggctagagcanntngccttcctangactctcaaantgctgggattacaggtgtgagccanangngcgtggcctctttttacnnnattgnnannnnaattattanggnannntcnaaggcnnaatgnattgncaccntcnntgctcacctnngacttgaccngntganctcatgnnatcnnannaccncatnctttcnannagctntgactacnagcagcacaccancctanccngctagtctgtatggcggagcacacacatggaatcaactcgtgtgcccaactcaggtagaactacngtactnaagngatncnnccgtctgnncncnnanggtgtcnngnttacacntttgagcnattncacangggnnatntcntcnntnntcaaatcttacaccttgggctangcttggaagtgtaangnatatanctgangacnccttagntttatgaagctncattgagggtncctgtaccaannatggncgcatccaactggnttccatcttcttaatcagaaatntnacattggngcagnngaaaaaaaaaaaagaactcgaggccttanactatagtgagtcgtntng

SEQ ID NO: 4819 - DNA, 579 bp, Homo sapiens
  misc_feature (1)...(579): n = A,T,C or G
ttaagcctttgntatctgttctttttgcaggatcccatcgattcgcgcaaactttncantctctctaaagaagatgatgtccgccagtatgttgtaagaaagcccttaaataaagaaggtaacaaacctangaccaaagcacccangattcagcgtnttgttactncacgtgtcctgcancacanacggcggnntnttgctctgacaagcanngtccaagaanagtaaccataaggctgcagaatatgctagactcttgncntcagaatgaangcngcttggcgnagcccannaacacantgcgaagagcctatgctgcntctctgtagcnntctctaantatgatcnnnnngaaatcatnntatgannccaatgataanacagcttaagaacgnggaaanccttaacttccagnnatcgctatctcngnagatctntattggcannnnctgangnaagatgttatctaaatgntgtcgttatgtcncttactgatncagtacacncttnatcatttgtangntgtgngttggagtctaattggcnncncttcttncctnacctcttagtcttatgtga

SEQ ID NO: 4820 - DNA, 1028 bp, Homo sapiens
  misc_feature (1)...(1028): n = A,T,C or G
cccccgccgnanaaactnnncnnatnnangnnncnnaanncaccnnncancnnnanannngnacgnnnanncncnnngcacnnnanacngcanagganntgncncncggattnnccntgaacctggaaaccgcntctancaggagnccngcgattcgaattcggcacgagagnncacaggnnntgcgncgacnanngctaaangcnanaacgggaanngagaagncgnggannnggngagncgatgacnggacacancnnatnngncaagnnggacgcttgnnnacgcagcnggaccnacanggtgcaagangccntcgacnacatanaannaccanaaaaaacccnaggcacgnggcacntcnccccggagnaangcancncnnnggganngccgacagngctgagaaanngcngnaanccaggaggtggaanangnacgagcaccnganaggcgccatngcnctncannnnnngcannnancagtgcactntnnncacangaaacaacacnacaganagtcaagcaccnnaaaanctcantacacnnccacaaggagcgcnnntggacccngctnctaagncggangtnggnntaagacnatcgngancccaccaanntccntggccaangnnaaaanangcnaaaannggnccntgntcggcannnngcnaantagcantgaaaaaanccggnnccatnaaaaancaacgggnncaancctnntnanngngngnngcaanagngggggcncaaanagnaaacccnnattgcacgcgnaggtnnntaattagagggnggcanacgggacancacncggaccgnaantanggcccncnacanaaactnnacccaaatcgcccagggaaancgnaaacgngacttttnacagaacttgnaancgnacgaaccccncgannagtnacanaangcagnnaganaaaaaantgngtcngcncnnnangnngnctcataggggacnnaaanaacataggganacacaccgngagcnaanaanattaagggcg

SEQ ID NO: 4821 - DNA, 832 bp, Homo sapiens
  misc_feature (1)...(832): n = A,T,C or G
antggnaannngggcaanaanncccttaagaannactgaanggaaaagcccgnagcgnntgggnggaanngggacgngaggggnnggangagggggtacagaccggnttttggncgncgnnttncgangancganggnggggnanntngggggggnangnnaaggggcggcagnggganaaagatgcggnggcgaggccangaaagganggaagggaagangggaannaagncaggngncccnngggcaacaaggaggnnaggggnacaggnagnaaagnngnggaagnggaccggagcagncnaaacngggagngnaanaggngggaagnaanggagngngcanaagnngagagagagnacncagngnagaaacaggcnnnagagaagcagcnggngnaaaaacnggcnggnannagnganagggagaggaggnannaaaggcangngaaaagaagganggcaganggaaggannggnaanaagcccangagagnnggnnnacnagagaanggggcaaaggcgacaggngggaaaggnaaaggganggnagaanngnagggggcnngaagnaacgagacgnnggannggggaggnanaanggnnaannagagggngaaggaaaggacaagnggnnganagnggnnagacgnangcngaanaggaggggaggagnaacngagnaganggaggnangnggaagggnggacngggnncnggagnnggaaggnggngannnaaggnnngggananggggnnnnaaaggggangnannaannnngnaagagggangggaggnnaagggnggggagagaggnnggagggcgaaaacc

SEQ ID NO: 4822 - DNA, 1036 bp, Homo sapiens
  misc_feature (1)...(1036): n = A,T,C or G
anngacngnnnaaacnnnnnnancnnnnnnnaaannnnngaaanngaaggnaacannaannngnnnnncgaaaaannngaanacaacnnncannnnnannacaccaggngnanaagnangnaaaggaacgcgcncncnannnncnnncgnngngannacgaaancggnnangacgntgaaanntagaatgcacagannnanannancnnantagnaaacatcnggnnncnnnannangcgacatntntnnccgnttggaaacgcttggcaatctccgacgcanagagagagagaagagctnncaanancnnagatagnnagnancgnananatanangnngtcannnnnanaggnnngaaacncnncnctctanntnncagctnnnggctcacagngganagncaacganggcagaaggaacatgagcctgatgaagagacnggaaanggagcacctgntcctgnacctncaaagagaacagnccaaagaaatacacccaagcanggangctcagagatnaatancagagagaggactnccancctnaaggcangnatnanganaaggcaaaanncaaaggtaaaggacatgagagctgaagacttgangangctaatcagacacanggagcactgggcacataggctannccctaaactgnagntngagganattatcgncagagcagaataccngggaagtaaaaaggaagnncagacctgnnnaaaacgaantcgantagaaccnnccctanatatacatgaagaatnntgntagcanatnatgatgaangctgcnggagaanaaangaaacactgaaagtnacnnnantacngaattnagaacccnnnntggacaaanntatactganaagngagaatggctngcnnncangagnnanagttgaanccctaacagnacgagcaaccancagagaaanngnnnaanaaantnaacaacntgggcntnggaaaagaaagcaaggcaaagcccgcaggannaaanaagtnnatgaaccctagnngaaaatggang

SEQ ID NO: 4823 - DNA, 711 bp, Homo sapiens
  misc_feature (1)...(711): n = A,T,C or G
tnaatncttgctctcgcctctngcaggatccctcgattcgaattcggcacgaggctacactgtggggggaagatgctgataaatttgatggttctagacagcccgtgttggctatcaaaggagcccgagtctctgatttcggtggacggagcctctccgtgctgtcttcaagcactatcattgcnaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgngccaaggcgacaagccggactactttagttctgtggccacagtggtgtatcttcgcaaagagaactgcatgtaccaagcctgcccgactcatgactgcaataagaaagtgattgatcaacngaatggatngtaccgcttgtgagaagtgcgacaccgaatttcccaattttcaagtacccgnntgatcctgtcagnaaatattgcanattttnaagnagaatcantgggtgacttgttttccaggagtctgctgaanctatccttggaccaaaatgctgcttatcttgnggaattanangacaagaatgaacngcctttgnagaagttttnccntaatgccaacttgcgaatctttcattattagaagc

SEQ ID NO: 4824 - DNA, 820 bp, Homo sapiens
  misc_feature (1)...(820): n = A,T,C or G
ncgncccntntttaaanccggcaanctttggaancctttggaaagccccgnnncgaanncggnacgaggcngggnntttcctgntacangcaaaancngcttcgagggaccacattttttcccccgnaacccgccgccngggaggggaagannntnaacctgggcccggcacagggtancctgnganannctgtgaccggaaaggcgcccnacccggantnagtggctccaantntcaatgcanccccacacccnnagttgttttnatcctgagaaaaaaaagggaggcngaattattnaaanttaaangagganancccntcntggaanggcngcngacccttcctgcagaaatggggagcacntgaggacacaggtgggtggaggcccnntgtgcgnngctggtcggattcnggcagccctccgtcncttnttataaaacnttgggngagaagantatattganaatgtcagtgaaacaagccnacattggnaatggaggcncagannacnccacaaggagcccttctgcntataaaancnagangcaaaaaacctttttnaattnntgtnaatnaaaaggaaagacttgntaggctcanatcnnanctgggngtgggnnnacgggggagaacactgcnaacaggganaaanggnngngcacacaanaaangagtggncgaaatttgnccangtggacccagccggggaaaaaacnnatanaaaaaaactcttcatagancctttttaaaaaaaaaaaaaaaaaaaaacttcgngccncagaaaaccaannggaggngacctatnccnnnagaanccg

SEQ ID NO: 4825 - DNA, 895 bp, Homo sapiens
  misc_feature (1)...(895): n = A,T,C or G
ggnnnngantgnntttnannccttgcaaacgnntcgctgagggancgnccgaatncggcncgcggaggaantnanatngtncatggnatanncngtnntttgtntgntatacagtgcntgnnngnagnggggntccgtactgctagnnangaacgtgcattcacagggttataaanataacgatgttagcaccaanccncttcnaccctncaatagggtgtnagatgcnnnanatggangntgcctatttaangnntntnnnntgcncnatatnngaattncngaggacnacttannnccgaaanntntacttnccgnaccgnanggcggaaagngnttatttttgatgactncgtgggtccgcncngagagctcctgctttgcctgcgcctcccgttctaaactgtnaccctttagttntngannaccnnncccgncttgggaacggtctgacnntcnctcgaaaanaggaagtggctnaanggcnggcttcttgacncgngnatcggatcctnnggcccnnccccnttccgttncaancttgcttntgcaacaagcgatngntnacgcttttnactganntcttttatntcgccatttnggattcccgngttccntgnaacnaaaangnccnggcggangtcaccnataaaacctgttccccttgcttacaanaagcannganggtgcccgtcngngccctggtcttgnanaacanggntgttggggaancntaaactnncccacatttgatggaanacncattttcatnnanccattnttaaaaacnggggntgngngcaacgccaanncctactccncactatccaaagntcccanntattggcggggcattcttcattggaaattntggatngaangaaacccttctcct

SEQ ID NO: 4826 - DNA, 759 bp, Homo sapiens
  misc_feature (1)...(759): n = A,T,C or G
tttcaaatcgcttggctactcgttctttctgcaggatcccatcgattcgaattcggcacgaggcctgtnattccancatncncngncacnaatnnaananggagnccttaggntcttaatgtgaacaggcagnngattangctgggcactcaggnagaanntcgcgtgtntcantnttnaggcatgtttcatgattcaaantactctccancccttgctctcaatgccttgcatgagccttgnatgattgnattaggactaccnanattancncnngtnatcncctttgntnaaanngaantcacnntgtatgtnacannatnctaatacntcaanaggnacnngtattntctgacnaaanagctaggcanctnaanatanccanattatatcnnnatcnntngncncttnattantacatacgnanacctngtaaggnatntttnncantggacattgctacagatcagntgacgattangtancctncataantaatnnanngcattgtacnttnacngatcgttctnccnctgncatgntncngttcctnagtganacanagctcntcgtattctggncgnntnnccgntatcngttnntaatgcanatatccctatgcaggtntcccatatnnntntnatnatgcatatagccttttgaangctccccatntnatatgcncatattccaccatatgaaatnttncctnnncgnactttggncacatgtaagncttggtnacccaanntaatcatc

SEQ ID NO: 4827 - DNA, 767 bp, Homo sapiens
  misc_feature (1)...(767): n = A,T,C or G
gaaancccctttgttactnngtnctttttgcaggatccctcgattcgaattcggcacgagggggattcataattccagacaggtagagaacggttttatttatgtagagacagagtctcgctctgtcgcccagctgaggcggggagaatcactttgacctgggaggtggaggttgcgctgagctgagatcattacactgcactccacctgggcaacagagtgagactatgtctcaaaaaaaaaaaannaaaaaaaaaactcgagcctctagaactatagtgagtcgtattacgtagatccagacatgataagatcattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggacccagcttttggtccctttantgagggttaattgcncgcttggcgtaatcatggcatagctggttcctgtgtgaaattgttatccgtcacaattncacacacatacgagccgggacataaagtgtaaagcctggggtgcctaatgagtgagctactcacattaattgcgttgcgctnctggccgctttccaatcggnaacctgtcgngccacttgcnttatgaatcggccacncccggggn

SEQ ID NO: 4828 - DNA, 719 bp, Homo sapiens
  misc_feature (1)...(719): n = A,T,C or G
ttctaatttnaatccttnaaatnggttctttntgcaggatcccatcgattcgaattcggcacgagagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtancatttgtgccaatttctggtttggaatggtgacaacatgctggagccaat

SEQ ID NO: 4829 - DNA, 887 bp, Homo sapiens
  misc_feature (1)...(887): n = A,T,C or G
nntttaaaaccttnnttttaacccttttaaaacctttcaactaccgggctttttgcaagancccatcgatttcgaattccgcacgaaggaaaacatggcacttnttnttgncatncntaacgggccctggccgctnacccgtggaaagtacaggtcctgacaactggggtncctgatgggcctgggtgacattatctcacaacaacttggtggagaggcggggtctgnaggaacaccangagaggcccggactctgaccatggtgtccctnggctntggctttgatggccctgtggtaggangctggacaanggtttgatcngancatncctgncaccaccaaantgggatgccctgaagaaaatgtttatggatcangggggctttgnccccgtgttttctangctgcnttntnccactnggtatggggcacttaatggaatggntaacncagnacaaanttgggcccaaactacatgcgggattatactagntgcccttatcacccactactntnttatggncntgctgtgccagntnnccaacttttannntgntgcccctttnattncaaanntggancgnngnccaaantgaancnttnttttttnttgaaccttcctacctntccctgggaanggcncaatatngnttatnaaanccttgccctcannttcnantngtnttcccaaccttttntaggggnntacaganttttgnnccccatgggaancnaggacaataacaaanctccttctaaaantggggggantaacccccntttctacnagnagtttgggtttttcccggtgncaaanantttantaaaggaatttggcaccccttggaagggnccccnttttanttcttaaaaaangtccacctgc

SEQ ID NO: 4830 - DNA, 858 bp, Homo sapiens
  misc_feature (1)...(858): n = A,T,C or G
ttnctaatnctngctatcgnagtnntntaagnncanttctaatacttggcancncgatntcgcnnnancatncnatacagtntncntctgnncgaggcncccangtncatggctnnatnnanggccatccatatgccagctgggggccaggcnacantggccatattgnctgnagcnngaatggtgcccacctacncgaattgaanggctaagagtcccagatagctaggccagagctgnaagcatacagtaaggggaanagctgctcccacagganagggatagattccatctcactgcgcancctgggaggaggcanggatcctgncacgctaagcctnaggcaccancctccctgtgctcgacatgcaaagtcatgactcctncttgntgagnactgagctaccttntactgctccaaancnnactaacagctctccaancccttggggtgactcgagatccnanganctgtngacttaantgangatantcagtcctgttctgccnnggcaggccanattcctncctccaanaancnnnatctttcnaaaccctgaanntgtancctntctnatttacccagctantttaannccaaatnttanaaanntanncnaataccnttactccnaaaccacttttgncttcnttacctgatannngnngnnctatactcacnntttagccntaaanngaanccttnctnnannagcnnatttgtcntttnancttggnaaactttctatntanaatnaccatccaaannttnnggnanntcnttaatnttttanccnanctacaatnnaacanctntaacctnantcctgtaantcnnacaaaattnntcnntancct

SEQ ID NO: 4831 - DNA, 1786 bp, Homo sapiens
  misc_feature (1)...(1786): n = A,T,C or G
cgnccnccnccnnccccnncggnnncngcnnnnacnnnccncnncgngcnacgncnncncnaccnnnnnangagcncnngncgnnannncncgccnacnangggntcgngncagcngnnnccangncnnncnncngnnngcncnggnanngcngnancnnnnannnncnacnnangctacnncagcnancnnncnngcnganagnncncnnnnagcgcnancncgcncncnccngcnancccacacnnacgnncanncgggncnngngnacnggnnccccnancntnnntcncnttttggccaacncngcctgggcancnacccnnnntcgccncagnaacgngngnangggnncgnnacnncnnccgnccccanngncccntntncnccngnagnntcnnnnncananccncagcanancnccanancncgccccngggggnnnncgnaccnccnnncacccgcgnagngcncncncannncgngncgcctcccncncncncgnaccccncnnnnngncccnccngccngcccncnnnannngccnannccnnncncccnanacacnncngncgagncccnnnnnncnncncnccncnnccccnnngncagacnactccnncnncnnccagncnccnncnacccgccnnngnnnnctccnnncgcangcannncnccngcccnnccccccggnnctggcacacgacncncncaccgcnncnnccccnnnnacnacgnngcncncnagcnnncacnnancanncanngacncngacacaccngcngaggcaacacgcncncaccnnnacacnccantnacgcatccggnncatcacgcncgcnnganccngacngagacaacncagcnnnnncncnagnnnacacgcnggcnacagactctcncacgnnacgccannnncgcacctccncnnnacaccnangcacccgngananccncgcacnngngnngctcanacgcancangcgcgncnangtcncnngacgcnncgnctcnacnccgcgngncnccaacgncgcgccanccnngacgncgncacnacngacgncacnnnncacaganaggacncactngngcgcannnccncncgncgncancncccgacgcnagtatanacnatgcnngnncagcacacannnnncnanaccngccgngccncacgctctcgngcagncacacgcggncgcctagagccnngcatcntagagcacgcgcannnntccngccacatngcacancnncanacnngcccncnncnnncagacccncnnnccanctccnganaccncgactcacaccncnctnncgcgcaanagnnncaggnanacgctcngctctncactgnganaccgcangacgncccttncnactcanacncncngncacagncacnctncnccgnacacncnctnncacatccgngnnatcncnncnannnacgnacannncgcgcaccngcacgcacaccanngnncngacgacccncncgntcanacctgcgancngctcatgcgccgtntctacacnccgncngtncnacncncgaccgncacagnncnncgctncgntnncnncgccnccgcgcgntcccancnncaggcnnctacnnnccagntatccngngtnnngnncaacgcncagcgntctcnncacanncccgangcgnngncnntncnnnngagagcacccagntanncaaccnnacnccaganaactcnaccnactcgntcacagnctcgctgtcnaccnggatacaccgaccccacc

SEQ ID NO: 4832 - DNA, 759 bp, Homo sapiens
  misc_feature (1)...(759): n = A,T,C or G
tttatgncntagtgaactctttgggaagcanntcccatcgattcgctcagattaaggggtttgaaaaacaaaccgaaaaagatgggcntnattnagccttacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagagtttcgctcttgttgcccaggctggagtgcaatggcgcaatctcggctcactgcaacccgatacctcctgagttcaagcgattctcctgcctcagcctctcaagtagctgggattacctgcgtatgccaccacacccagctaatttttttttttgaatttagtagagatggggatttcacccatgttaatcangctgatctagaactnctggacctcaggtgatccanccggcttgggcttccaaaaggactgggattaccagcgtgagccactgnacccaaaccgnctaaaccttttaaaaaaggattatttgg

SEQ ID NO: 4833 - DNA, 772 bp, Homo sapiens
  misc_feature (1)...(772): n = A,T,C or G
ccaacgcnggctacttgttctttttgcaggatcccatcgattcgaattcggcacgaggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaaganagccangatttaggtaatgagtggatgagtaaatggtggaggatgggagtcaaaatcagaattatnggaagaagtatttcctgtaactatngaaaganttatgtatatatacatgccanaaatatatatgtgtgtgtgtntctgnggatggatatatgtatatctcttcctatatatatccc

SEQ ID NO: 4834 - DNA, 833 bp, Homo sapiens
  misc_feature (1)...(833): n = A,T,C or G
ggnncnnnnntttttaactcntgccctttgaannccttggtacctcncnnngganggggccctngttnnaattcgctncnacccanngatgggccagngggngaacttncttgagtatgtcgccnttccggnggncgttnnctnngttctacnnagaacncttngagggctgaaaataaatntggaagatnganacaccctntgngggtcctctctgagacaaatccatntggtgggtaattgnacantaaatnttttttgntcaaatntnnaaaaaaaaaanangcctntacaactcttgtgagtcntnttaccnccatccnnacatgataatgatacatatgatgatgttggncacaaccaacatctagaagtgcgnttnaaaaaaangctntntttgcgnaanntnngatnctnttgnttnnttngannccnttgngcctgnataaacaagttaacaacgacanttctttcattaggggagtcngnatnatggtgggggccangnangngttcntgaatctngcntcgtctcctncaggncatntncacnacacccgaantttgggcatnttnttttgncntntgaacggnnnctnggngttnatcaaggatatnnnntttcctgtgtgcaaaatttgtcccctcncnaattccacnctngcatgccatcccggnatcattnaagggtaaaantcctggggggnngccnnatgcagtnngcncaacctcncatttgnatngctggttggancataantggccctgctattttanttgcgnggnanaacatnncntggggcctntngtgncatntaanatanattggggcg

SEQ ID NO: 4835 - DNA, 773 bp, Homo sapiens
  misc_feature (1)...(773): n = A,T,C or G
tttattccatcagctcttgtcttttgcngatccctcgattcgaattcggcacgagattctccctaaatagtaaatcccactgtatacaaaactgttctcttgttctgccttttaaaatgttcatgtagaaaattaatgaactatagggaatagctctagggagaacaaatgtgctttctgtaaaaaggcagaccaggggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggnatcttttcaattaatgtatctgtaaaaagtttctttgtaaatactatgtgttctggtgtgtcttaaaattncaaacaaaatgatccctgcatttcctgaagatgtttaaacgtgagaagtctggtaggcaaagcagtctgagaaagaaataggaaatgcngaaatagggtttgtctgggtgcatataatctttgctctttttaagctctgtgactctgaaatatatttttgggttcttcagtgtgtttggacaagacacttgatatttctatcaaacaaatgactttcatattgcaccaatctttgtaagaccactcaaataaaagcttttaaaangcaaaaaaaaaaaaaaa

SEQ ID NO: 4836 - DNA, 855 bp, Homo sapiens
  misc_feature (1)...(855): n = A,T,C or G
gccnnttgannccatcanctcttgttctttttgcaggatcccatcgattcgaattcggcacgaggggcncaaannatntcntgatgacaaananctctgtatancaggtcantcncagtgttnanagtctcagttgcttgcttggggaactngngtccctaatgngaatagnntgctngattgctcnggcnctgntactgtgacagtgtttttagacctgtgttnctaaaaaaaanatnaatgcnctgaaaagggtgttgggagggtggttcancatagaaacanagatgttanggtgtttagatttanggttggnaacaaggtcatctttagtcaccncactgggnaggcagcatttgctacattggcnnactaactnccnttgctannnnntttcangantncaannacntgtgnatcntagtatnnnagnntgaaatnantttccaccannagcgggcattgtttctatcacagcataggctatgtnaagcnaactctannatgataaatgacacccnntnttatctattngcatcgacccccgtctctacaagaaagtnaccaaaaattttncccgggcatgntggtnggggcaccctgtnggtccccagctatttcaaaaaaggcttganggnggggaggaatcacttggacccccgggggggggtggagggttgcanttgannccaaatcnacgcccactgcanttcccgncttggggtggacacaagngagacccccattttataaaaaaanaatnaanacctcctttggnaacnngggggnaaantctnttctttttnangaanttttcntgntnggactttggggttcctctatgactttcatntc

SEQ ID NO: 4837 - DNA, 932 bp, Homo sapiens
  misc_feature (1)...(932): n = A,T,C or G
nnnnnngannnnanagannnnnnnnnngannanntcctnttnnnntagganttgnaaatncctcgttctaaatncttggtaaacncctngctnnanggtncgngccactntgtccggnncgagggtgggcncacacnctaatntcnctgggtccatggtantnccnattangcatgctgtgttnntgcanatgatgtantacganatccacggtgttnggttaatgatttattcactcattagtcattccacaaactagtctngagcaccngttatgnacccancactgtgctggaatgctgaggagacaggagtgaagtaaaaagacatggntccngcaggaaacaggcaaggagagccttgacttgacggantctggcaatancgccaggctggaatgcaatggcgcgatctctcctcactggancctacgnctncngggntnaagcaantctactgcctcagnanctggagtanctnggnactacaggcnngcgctaccacncgcnnatgagaaaacttnnngccacagagaggtgaaataagtgagatgcttnctaacctaatgcganaaccncgtgaaaagatttttggcaacctgaaaaatcccatnctnnnntgaggattntatngncaaccngnaatcaantcttaggnaanatgaatgccnnttcgggantaaattcnatttttnntnatctcccannaaggaaggaaaacntnnnaagcctctangaatnatnnngncttnctaacccngngtantcaaaactnttnncnaatctattggnaaacccgatctaganntttttnaatnaccntnaaaatctnnaaaagaaagnncaatnagtatnttattcactcgaaaagtctccaaancncnntaaaagaactcnantggaccaaactacncnttggnggaannttaancc

SEQ ID NO: 4838 - DNA, 1358 bp, Homo sapiens
  misc_feature (1)...(1358): n = A,T,C or G
ttgnnggaaccccnnntttttttnttaaaaaaaanccccccantttcccnaangggcccttaacctccnggttnttgtantntntttttactgatnngaaangagcanaacncncagatngntnantgtaaantttnctatcncnccncnaangtancttnctttgtatccaaccnnggtntagtcgtctcnnncntagancttaantatataannnataaacacctaccgtgntatanntntgtacanntannnncngcgcgnngngcancnnangtcatatanaccntgcgccanatncttctacanactacanccntatnanggnttnnataaagttcttaataacgcatcatnntgttcaacaactggggtagctatantgaacantctnancacnnaannatngnttcncaaaagganaancatctcnntatangantaccctnnntttgnncaatnatatnaaatncnntgancnancncncgtntgnntnnaagnnntgaatctngncaatatgttggnnnnngcntnntnnntttnanattnanaaaccttgncntnatnatncatgtggtatgtnaanacgtncnttaaaataggnnnaagacgnnccnattgccnnacnttatanaatntcntnnnnccatnntgctcgattntgattacaaatattgntgcngannggnanaatnacctcnatcttgatnccttnnaatannnannnaaanaattnnntnctttctnnntcacacnacattccnacgtaccntnatnatctttgtnnnacgtcattgtacnaacaacttaatgtagctttgnnanacnnaacaatntcctctctttgnnnnnanggnatgcacncatttccnnttgntantaacctanntcngnnaatattgtaatagncncttaacgcntcnaantctcgggtaatcnnancaaaggtttgtcacnaattctnnnccgttncnangcntaactntntncntaanacatngattgnttaactcgaangnatatgancgcgancgcatgnncncanancgtcacttcttgggatacccncgctctactttanactctttaangncananggttacganactgcactngnactgtangcttngtttactctnccnccgnnaanactcntcnatangatgnttangcnccnacgcnannntnncgnantctatncgagcanantnaacnnnctccanatnaanaaaatngtnnntgtngnacanataanngacntatccttctgtatattctcgacgcgaananatggtacgtgagngntttacntaangtancanatntgnggttnacactnnnntatncgagcctccg

SEQ ID NO: 4839 - DNA, 716 bp, Homo sapiens
  misc_feature (1)...(716): n = A,T,C or G
gnnntttnanatcagctacttgttctttttgcaggatcccatcgattcgctgaaatgtcaaacacggccacctaggcagcatttacaancaagagtccactgcttnnttgatgtatatcttaagcgcccccagtgaatgaacagcatataactccacataaaaatcattaaatgtnattgacttccagagcaggcagttctgtgtgtatgcctctggagaaggctggctgaattgnaattggtctgtacctnctgcctatcatgtacatgangtnnttgggcaaagagaactttccanaanataagtccanaaattatagatcatcanacnaccaatgacatattgntgagatatctncaagatctagaatngncctgggtgtcaaggaagtctntggggtttttacaaatattgataatgcnctttttataaaatgcactttttataaaaatgcatgctcacttgagacaacttgaaaaacacactagaaaaggccgggcgtagtggctcacgcntgtaatcccagcactctgggaggccgngacggntggatcacgatgcangagattgagaccatcctggctnacatggtgaaaccccgtntctactaaaaatncacnaaaattagcanggtgttggtgacgnggcgcctatagtcccatctactnaagaagcttgatgcangaaaaatggtgtgaacccaggaaacgagctt

SEQ ID NO: 4840 - DNA, 758 bp, Homo sapiens
  misc_feature (1)...(758): n = A,T,C or G
angcagctcttgttctnctttcaggaccctatcgattcgaattcggcacgagccaagctgtaccagagtgcangaggcatgccaggaggaatgcctgggggatttcctggtggtggagctcctccctctggtggngcttcctcagggcccaccattgaagaggttgattaanccaaccaagtgtngatgtancattgntccacacatttaaaacatttgaaggacctaaattcgtagcaaattctgnggcagttntaaaaagttaagctgctatagtaagttactgggcattctcaatactngaatatggaacatatgcacaggggaaggaaataacattgcactttataaacactgtattgtaagtggaaaatgcaatgtcttaaatnaaactatttaaaattggcaccataaaaaaaaataaaagaaaactcnngcctctagaactatagtgagtcgtattacgtagatccanacatgataagatacattgatgagtttggacaaaccacanctagaatgcnnngaaaaaaatgctttatttgtgaaatttgagatgctattgctttatttgtgccattatgagctgcaataaacaagtnaacaacacaggttgcattcatttnatgtttcaaggttcaaggggnaggtgtggggaggctacttaatttcattgacgcngggnccttgcnttnngggcnnngaccccagntttttgtncctttngnggagggttaantncnaacttngggttaann

SEQ ID NO: 4841 - DNA, 739 bp, Homo sapiens
  misc_feature (1)...(739): n = A,T,C or G
agnnnantnctatgatcccttgnnncaggatccatcgattcgaattcggcacgagtgcctttgntccccaactctagggagctagtttcatacatttaanancnctgcttacctcanagctccctttnagcancngcagacttnnanatctgtttaaccagttccctatattaaattctctctggnnaaatacatggnngggctttgattanctgctgaaccctnagngatncataccnnatnatgctncnnaannnatgcnatanncntacaannatntgtantnnaggatncctatnncnanactgctngtnntancancatcancatgacannnacctttaaangtnttcnatntanctanaattatctaaaatgttaaangncntaaaacannnnantaagcaaaagatganntcaagtgtatgtncatttagtagtgacttgtgagatttgacgtgttcatgacagctggctatttgtattgtctgaatgatagtgtatttgngtactttgcccattgcctattggggcattntaaaatngatccttaggtaatgttaattaagaacattgacctngggcanggcgcggtngctcacncctgtagnncnaacacnttncgagggcgangcagnaaattcnananaangagtttgatacatctgggcaacatngcgaaacctgnctntctanaatntananttagccggcanggnggagctgcngantccagtag

SEQ ID NO: 4842 - DNA, 750 bp, Homo sapiens
  misc_feature (1)...(750): n = A,T,C or G
ttatnnntaccgctttgcnactncncgcaggatccctcgattcgaattcggcacgagggtgattcagatgatggcgaagatggtcgaggttntgagaacgganaaatnaaggcncttcggacagctnctctggcaatgtatctgaaggggaaagccctnctgacagccatggaggactctttccagggaagacagnnatcaaangacaaagctgccactccangaaaagatggtcccaaacgttctgtactgtccaagtcagttcctgggtacaagccaaaggtcattccaaatgctatatgtggaatttgnctgaatggtnaggagtccaacatgaaaggaaaggctgnatcactnatacactgctcccaatgtgagaatantggccatccttcttgcctggatatgacaatggagctngnttctatgattaagacctacccatggcanngcatggaatgtaaaacatgcatnatatgtggacaaccccaccatgaanaagaaatgatgttctgngatatgtgngacagangttatcatactttttgagtgggccttggtgctattccatnacgtcgctgnatttgtgactggtgtcaacngncccncccaacacccagtaaantgtggcaaaaaggggaaaaatnagcaaagagggatnaaancgtttttgactctaatctgtatatgcatttaagtggaatatttggtgccattttcaacattantttcatgcccataaaagaatnt

SEQ ID NO: 4843 - DNA, 730 bp, Homo sapiens
  misc_feature (1)...(730): n = A,T,C or G
tnnctttgattcaattcatagcnactggttctttttgcaggatcccatcgattcgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctctttttcaaaaggaatgactttaataaccatagcaacacttactcagttttgtgatccactccaagattatgggagcaagaacagatnctcctgaaagcaaccctcaccttcttccccgcccctgccctcagcaagtcctggcctgtgtgaactgaagggtttggaagctctggtttctangagtgcccanaactagaaagactagggtgtctaattatttgaggggcanttgtcaatggcantgtggggggcaccccattgttatttcgaggcactgcattgctttttt

SEQ ID NO: 4844 - DNA, 818 bp, Homo sapiens
  misc_feature (1)...(818): n = A,T,C or G
tntcctncgcgngncgnattccnctaaggagaggcncggatccctcgattcgaattcggcacgagtctcgatctcccgacctcgtttccgcntgcctcggcctcccnnnnngcngnnattacaggcgngagccaccgagctngncctggatcaaatcttaatccatgcgcatgggnacacaagantactgggttgaannnattctagntttgtnatttaaatacntgnngatgaatctattttagcacanggtataaataactcgggaggtcatctctatcttctctccttnantgcatttgggtataccacgtttaagnnctaaaacagctnngcntatgttggccaggggaaaacatggcatnctgtgcgcaaagntnaatgatcgcngnccnnncttggcccctccctgggtttatggncancgtaagangcccgcatgttaaagcttaaaccgtcanttgggctnggtgtaaatccccnattnaattcntggnnggncaannctcttgaccccgnaaacaatggaaagggccanctggggcctcnaanntgtnggagccccnnttaacaaacnnttantngnaaacctttggaattccaaccttnaaagggaggggnaccatggaagatanttgagtggcccgntnggaattgnanccccttnaangcaattagtttcnccnaattttcctggttnanaaaanatgcnccnaanaccnggggggcccaannctgggctaaagccggnggggctcncanaaccngggtttttaactntngatacantanggngaaanaangggcccctttttaan

SEQ ID NO: 4845 - DNA, 748 bp, Homo sapiens
  misc_feature (1)...(748): n = A,T,C or G
agcttcattnnactatcagntgcgctgctntangtgcnggatccnttcgaatccngcncgaggcgnganggcangganngcagngcncangnccnnttaagcnnttttctgtcttatcacncagngaatnaanntgaactggatcngaacnatcccatattanccgatcctttnctcnnatgaaagaaaanacntannnagaacanatangctnaaactgatacagnaagtngccgtcagcctctagaactatagtgagnngaatgncntacanccanacntgatnananacattgatgagtttngncaaaccacatctngantgcantgaaaaaaatgcnctattcgngaaancantgatgctattgctttanttnggaaccattataagctgnnataaacaagctaacaacaacnattgcattcatnnnatgctncaggancacgnngaggtgnaggaggnagtgtaattcgnggccncggagccaatgcattgggcccagacccacntntgaccctntagtgagggttaatggcgcncttngcgtaatcatggtcatagctgcttccngcgtnnanttgatanccggtgcaatntcancacatacgaccgggacataaagtgaaagcctggagnancctaangaagtgaccaactcacattnatngcctgngntaactgncccnttccagtngggaaaccnnnncgccanatgcttaangaatcngncacccgccggganaggcg

SEQ ID NO: 4846 - DNA, 704 bp, Homo sapiens
  misc_feature (1)...(704): n = A,T,C or G
gnnttnaaannttgcttggnnnnnncnctttccgcaggatccnanncgattcgaattcggcacgaggtncagctcncctanctggnatntgggnngtnngaaacatncnctntcctgataccantgtgcnngaatcanganacatangccattacacngcgtctatgcaagcttgcacataacntcangtactgcagctcacacaccctntgcnaggcngaatnantngntctgcctccggatacnaanaatntcggctcngcctcagngctaatgatcntnatgtngtgtnctnnagtanntgctgtatctgngtgttatntntgccaaactctagntantgatcttatgatcccttntngaantaanatggggttcttgantgnctgagaacgacttgcacaatgngttnattgtggcacgtcatctnncaatgantannnagnctattnnccanggnanactcngntcntacntggcnctaagcactntnttgncgatngncancnctctgtgaaatggaattacngntattcatggntaattacnnattttggcccnctttctgtttntacaatgaaggcttaaanctaantgtccaaantgnataatgntcccttaattanaagnctacttcattcaagtganaanngnccgtaatnaanncntactctncnactgcataatatnnncctnaggactnn

SEQ ID NO: 4847 - DNA, 758 bp, Homo sapiens
  misc_feature (1)...(758): n = A,T,C or G
agntntttcnatttctnatnttgttctttctgcaggatcccatcgattcgaattcggcacgagagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattncagcacccgtttctacatctgccatcttactctgcctttctgctttggatgtggnctctacactaaccttnttgatgtccanggtagatnaanggtcgaatctttntgnaaaa

SEQ ID NO: 4848 - DNA, 1030 bp, Homo sapiens
  misc_feature (1)...(1030): n = A,T,C or G
gcgtcncactttgaancntcnaanngngggcaatcnaatcgcncnangnnnctaggtanncgaattcggcacnagagcaggcgcttggnccctaaggtggatgttagagtagtgattatggtcagcgtgggtgctatncnngtgttncagnttttcanctggnggaatagctacaataaggnaatcagctacctagccacagngcccaagtnccgtntccaagctacngagattgccaagcancanggactgntcaaaaaagccaaataaaaaggcnaaaacaaaaagtccaangangatatccgngacnaggangagaacatcntaaagaacattataaaaagcaanatantatttanagggtgnctantcagnaacnccaaatantgngnatcntcctctgtatnanatcaatcctagctccntntnncctatnctcatatccnannctggcatangtcnggagagatctacnntttcaacatcaancggntnnnnattatggnanagnantnacagatcantccattctacnntaaatctatnaccnngtnnactnctctattnnaatnnnactatgaanatnctctnaactaaancntttcntttanncnaaaancctcntgnnctncatggnnnnaattnnttacngtccttnccaaaccnncnanacacncacngancntaatcttcacaantannaacantctgngctnanctcgaacncccctnaattggctnaccannatcntccactggnatcatncggtantgganttaaanngcaactcggntctctgnggnctnctgnattncaannatcnnnntgcgnntatttntcttgcacacaatatannctcncgnaatttnncntanncttnnnnctctcaaatactctctctanacatagagcaattanntntctgatnatactntngaccncgtcantcacnacgngcacaanannatatcattgtacattcatntatctgtngactttacnacagtcccngccaatntaacaaacnnt

SEQ ID NO: 4849 - DNA, 761 bp, Homo sapiens
  misc_feature (1)...(761): n = A,T,C or G
cnttncctnancaggtatggccattnccntttntgcaggatcccatcgattcgcctgtccgagagagccccgctcacggggcacagctgctactttttaggccntgctgcacttccggacccactgcttcaactggcactcccccacgtacgagtatgcgttgagacatttgtacgtgctggtcaacctttgtgagaagccgtatccacttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggangtttgtnggtttgcctgcagttttgaggagcaggaagctcatgggggcttntgtaccccctttaaaaggagtcnntattctganaantngaanctgaaacctttntaaatcttcanaaangattttattngaanaaggnccnnancnccnaaanggaaaacnnnnntnnaaaanntnatnantttttgaaagnnntngnnttnnaaactannnnngnnnncnnaanccaancnnnnnnnnaanaccn

SEQ ID NO: 4850 - DNA, 863 bp, Homo sapiens
  misc_feature (1)...(863): n = A,T,C or G
ttnacatcaagctcttgntnctanccccttcctcgattcgaattcggcacgaggagagagagagagagagagagagagagagagagagagagagagagagattnagagagagagagagagagagagagagagagagagagagagagagagagagagagagagagagagagagagagagagagagagagagagagagagagagagagagagagagagagagagctnaagggaaggctgccgggaaggcaaatggaacaggaatggacctgtctcangaaggccagctgcangtcctccacaaaatcaaagaagggaagaaactctgagtttgaggtacaggggcttcngggtgcacacgtccctccagggcccatggtcagtattgcacctgtgttatgaacccccatatctgtgcagggcaggggcgggggctgctgttttattggggaggggagcctcctaaaaatggggtccaggcagacccctccagacctcacactgncgaggaggcctttcccaaaggggcgttctccccgggatgcanaccgnatgttttgtgggaaaccnccctttaaataccccacaccgacgtattccttgttcccgactttttcccgggttntttgttttgaaaaatacctgtnngtttcangcctcnttggatcttaaaatgggcaanaatagggaacctttttttttgtcaccaaaaaaaatacctggggggggaaaaattgtttgtnaaaaaaataagacntttttgggaccaccaccaacnttttttggggggctttccaccttgaanctttccaanttttttttaaaccatgggganttttattnaaccnttaaatggtttttcttgg

SEQ ID NO: 4851 - DNA, 761 bp, Homo sapiens
  misc_feature (1)...(761): n = A,T,C or G
cgcgggcgnaagcgnagcncttcccaacnnccttggatccnatcgncccgaattcggcacgagtatgggcttgnagaaatgctaccgtttttttncccgttnanacntggatcccgaaactgnactaacgtnnagtatcaggcnnaatgncnggaaagggnnggcttatgnaggcaactacagatagttgtaagggatcatacagaagatattgatgatagnngaaatattcttagaaggggtgtgtatgtctagctgngtctaccatgtgtatgtattcttgacaagcagtataaaatacctgtganttttctttacattagggataatgcataaggaattaatcttcatatatattatcatccctaatgtagcagggggaagtatttaattgcccatgatatgtattttacttatactatgccagagaggaaacnataaagnaattacacatgtaatcntgggttnttcacatatgtaggtatncatttngagtaggttgaagaaagaaaaaaaatatttaaatgaantgaattcctgatgggatagtancaataagtatttaaaagccngtattcnaaaaataataaagggtacggncatttttgagcttgnnnttcntttgctacnggaaatantccaaannaaagngntancantggcaccngctggnctcaacgcacntattggnaaccgcactgganaggatgaacaaggggtnagncaatagcaaacccctataacattccnggccaaanacc

SEQ ID NO: 4852 - DNA, 779 bp, Homo sapiens
  misc_feature (1)...(779): n = A,T,C or G
ttgaacctttntacanctcttgttttttttgcaggatcccatcgattcgaattcggcacgagaccaagtagaccagaaactgaccattctcagtcctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttncagagctcaataaggtcaaaaaggaagttacctctgtgacatcttgggatgtaaacactttgggatttggtatagaataacccattgaaatttctgctgtgccgaaggtggtagaaatttacttttttgggtatatcttat

SEQ ID NO: 4853 - DNA, 825 bp, Homo sapiens
  misc_feature (1)...(825): n = A,T,C or G
tttccagttttanttttttcancttttngatcnntttgcaggatccntcttttcgaattcggcacgagattctccctaaattgtngatcccactgtttacnaaactgttctnttgtgctggcntgctnantgctntgtagnncctttctgnacnntaggcattgctcttggagaacnngatgtgctttntntnaaanggcanaccagngntgnnctgnntttaatgatgcagancctnactttatccacacctggcccgtttnacatttnagtaangnacgatatttggctgatggctgaacantttctgaaatacacntttagtgtatggaantacaagaccnntaaaggnctgccaggttancatctcatctngcattcnnntcctttggcnanaaaggganatntcagaattatatttcttgatggggtcttttcaatcantgtatctgtcgaaanntcttaganaaanctatgtgntcncggtgttgtctaaaaanatnctttcaaanatgacccctggaattncctgananangcttaaacgtgagaagacnggtnggcaaaacaccctncnaaggttnttggnaangcccnantntgttttgtctggcccatataancttngcnccattnaagccncgggngagctttgnatntatattngnggngttactttctttgnncctttgcggggaacancttnnataatgcttntcnncccnanntggacntttgctttttgnnnccnnacccccccaaagggngcncacctccantgaaaaagtctttttnnaaaagggctccttnctnaaaaaaannnnt

SEQ ID NO: 4854 - DNA, 1090 bp, Homo sapiens
  misc_feature (1)...(1090): n = A,T,C or G
gaaaggaagcacgcaaagcaactcccagcagcatcccagcnaaangcccagaggaaggnacnnngcagnacnacccncncgngcaccgcnttnttttccccagtaggngnngacacgccaacnnnnggggnccncgnggacaagaggcngancccaaaacnngacagggcaaggacccnncagacncgggganggngaccagagcgcggccnagcgagaaacagccngcnaccgnnaggccanaaancangccgctgaaggganccgggctccggccntaaacnccancactgacacgacccagcaaaccccncaagaggaaaaagacccccaagggnnaaacacaagcnnagggcangnncacgggggacccccgaccgncnancncggggaagccngccgnangaacggganangncacnangggngcataagaccnaccacncagggccnaccanggagaaaaaaanancgnacnanaaaggncaaaccgcaacnccggaaggggcacccacnaagggggaacccccnaangggctcgnaccgggcgccantngccaaagnnggncncccncaaacgacccggggggncnaaacccccccgggggccanccacncanggggggganccccaangganggcaaagcccccaaagccccnccgggggcaacccaaaaanccnnggagcccngngncccanaganacnggaaacccgggggacgnccccaanacncagacnaaaaaagcgngggancccccaaaaaaagcaaanngcacacncccccgagngnaccnangncaangggggnaaagacaaaanagaccccnnnganaaganccccnnaaaggccccacgggggaaacnngggacncncaggggncccccccnggggaccncggggngngccnanaacccncaaaaaacgggggaaaacncccccccccanaaaaggcccacnggacnnanaanccccccncccngggaggnnncccnaccncccnngnncccnangaaaaacnanannggggnaaaaaccccnngggngnccaaaaaaagggggaaacccnccgaggggggnganncccgc

SEQ ID NO: 4855 - DNA, 779 bp, Homo sapiens
  misc_feature (1)...(779): n = A,T,C or G
gctaanngcnggctactngttctttttgcaggatcccatcgattcgaattcggcacgagggntggggnntcgncggncncgctangnnngccatacncaatntnnagagtctanngnntgtaannttgctgcttatatgtacctgtgcttatattcgancctngnnncncatncttctggacngaagtaagactggattgttgggtatattaggggnanngtgccagagatcngtgaacggcanagnccttatgtggccnantgcngtgtaatantggccttaagnatcctnttcanacannagctgnnnaaaatgccnnantgtagcanncatnntatnagnttgnnaacanngactgncngcccanaataanggctgggatgttgaactctggantctncgaacattgngtgagananattgncngangctgtantctnttttaatgtgatnggnccaatgnnctgtataaaccnttangatgtacccnttnnatattcngtaccnntnatcctcagtantgtcactacagtatcacatantgcatatgttatcctgttgtancagatactgaacttagtgaggtntcnctaaggcacntagananaaancaannttggttanntnctnncgtatctntcactgtganttgcanatgatntantctttatanaatgnganccttttaccggnctaanttttnaattaaaatggctnattntgtgttgataaaaaaaactcgagcatacttnnaccctctngaactatanttgagtcn

SEQ ID NO: 4856 - DNA, 1776 bp, Homo sapiens
  misc_feature (1)...(1776): n = A,T,C or G
ggnggagggnnnggnttttnnaggngngntttannngtggggaaaaaaccccttttttnttaaaaannnnactttggggngaaangnngctgnanatantcggcctnnngngananagngagtcgngnggganagnnggntgnnnnnngnagngatataggntangantagtananggatananngagcagngaacngtagttttttttnagngaganannngagnnaanaggnanacnatnanaganngggggggggcgcaanggggtgnnaaggcgaganncnaactcgnannanaantgaaannnnnanacngtgnnananantgagcgnngatnnatnnntgcaanncataagaantngnaatgnannntgnnngnacaaannnctncganagnnngcaagngaatncgnancnnacnnnagngnagaagnagtannangaccnnnaanggantncngagaggnnnnanaaggatgnnnannnanngnaganngnngaananaagaggagacnaactatannagntagnntgncnanngnagannananaagcnganaganannnntgngagnanncanangnggnanntaaagnnnnannacgtatangagntgtgtnagaactgaaganaannancacgnaaatgaanaacatncnnngancnanncgaangaaaatatcacgctganngnagatagatanacgctcnntatnganncagtnactgtganatctgcganangacancacngnnagntnnacnacacagatgnangctnananangnagcagagtanaagacnnggagnngngtncgcanatatcgatatnaagnntacganagtgannanangaanantgantnaggataacgannagnnngntntatnngggntanaggngagagntanantgctgcncncnanannanngaatncagcgcnngncgancangnnanaatngggnannganananantgtannnanagcaangntannagtgactntnnngtaatngatngagnnagnnganatgagtgctctgncnntagcgaganantacngngaatntntanagagntgtagagnagcagcananannantntcngngtnnaangtagagagcgangganactnnntagtatanncaganacgangangnggtgtgnanncggagtgtagagncgattagagagnaaacnnngncacggtgtatnanagatngagacangangagaactgcnnacaagnanntannnaatangtacnnaatgngancataagtatnacacaggtnactntatanngnncatcaacgcncgantntanaaacnntagnttnacnannaaagctacgttctnnncnagaagaagnactnnanganntngagcngcacganaagtatcgtnggaacgagcantcgtnnatgaganagtanacangcaaanaggaagnnnagnaacagtcacangncagangaaacatnctcacnngnnanttancgnnganacgtaaatgtagacacgnaggagatnaannngatatgangganannnaaagagtanatgcgtantngnatnaganangananaagtnaagagantgacnanatanatgatntanganagacgganganataatctggaagcgnggaanagantagagatagnngaganggatcnngtanacagntcnnngncnnctanatgaganngnncaactgtntatacgatntannnaggnagatcaagaatatacnntctcct

SEQ ID NO: 4857 - DNA, 747 bp, Homo sapiens
  misc_feature (1)...(747): n = A,T,C or G
gttaatctctagcnaggctcttgntntttctgcaggatcccatcgattcgaattcggcncgaggttaanagaatnaaaaagaatgattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaatanagcantcacacaaaggaataagggaaagtaattaaatggtcctgtacnggaaaaccaccaacccanaattggaanaaanaattnancttnaaaaacctcgagcctcttgaactt

SEQ ID NO: 4858 - DNA, 1197 bp, Homo sapiens; identical to SEQ ID NO: 4691
  misc_feature (1)...(1197): n = A,T,C or G

SEQ ID NO: 4859 - DNA, 767 bp, Homo sapiens; identical to SEQ ID NO: 4827
  misc_feature (1)...(767): n = A,T,C or G

SEQ ID NO: 4860 - DNA, 761 bp, Homo sapiens
  misc_feature (1)...(761): n = A,T,C or G
ngnntttaagatcannccaagcgcttggtgcaggatccctcgattcgaattcggcacgaggaccacctacggaaaactgaggcccacataagctcgattggttgtacctccaacagatatttattaagcacctactaaatactgagcccattgcaagcaccagggaagcctctgtgaacagcacaaggtccctgctctggagattctgcttcagtggtggagacagaaaataaacagtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgnattcctgaatgatatcttcacagcancaaatggagtttataccaaacagaaaatggacccaaaggagctaggggaaatccggagtctttctacaatgcctgntttntgaattatccaacttcttattattagtggcttcactgganaacctgnct

SEQ ID NO: 4861 - DNA, 984 bp, Homo sapiens
  misc_feature (1)...(984): n = A,T,C or G
tgngnttttttaaaaaccagctacttnttatnaaggcaggcnaccgattcnnattgcgggangancatngattcgngcccctgcatgatggtggcngaactnnntgcccaaagtggggcctgggancccaacaaccccaacangccgncncggtnaaccnacaatatcaacccgcaaaccccagggacgccggccatgtacaacacagaccagatctctccctatgctgccccctncccacaaggttttctnccancccatgcccagcccccanagctaccaccaagtggtgccaancccagcangctaccatnaatacccantccccatncaggtccaccntacaccgtntaccatggtctatcaggctatccccancccgagcnccgtttggctacaggtctatgacaacctggnagctccctntcccatgggngggtanaaancccaacaaaactgctcaaggcttnaagggtattntgaagcgngaaaantttcgggcagaacttggggttnacccnacctggnncantttntaagggtngaaaanggttgccggggggaanaaccctttactccttgggaattaacnaacnaagggttggggtggggggaacaaacnaacaaagggggngggttaantccccccccngtnnggttnnacnggggtttccccttggggggggcccccaaaagggttngggnangngggttnggagccaaggnaaattncnctntttncctttnggggtanccccccctttaaaacttngggaagaaaaagaaactttnnttcccnaaaattgggtgnaanagncccccaaaagnngggcaaaaagcttggggatttgngggaaaccntaaagggggaaagggggagactttttnaaancccaaaggganggncttttaacttgatttaaacgggggaaannaanggagggnttncttggggaaagganaaantttntgccaaanaaccnc

SEQ ID NO: 4862 - DNA, 772 bp, Homo sapiens
  misc_feature (1)...(772): n = A,T,C or G
ggnnnggtttanancagctctngatctcngtgcacganccctcgtttgnatgatcnnatcgattcgctcangtcggntgccatttatggnatnactttattttatttnattgcattatnatatnatnttgagacagagtctcactctgnnacccangctggantgcagtggccggatctcggctcactacaagctctgcctcctgggttcacgccattctactgnctcaacctncngagtanctgggactncaggcgcctgccactgggcccggctaatgtntngtattnttagtaganacagggtttcaccatatnanccaggatggnctcgntctnntgaccttgttatctgcccgactngacctnccaaagtgctgggattacaggcgtgagtnaccatgcccagnctcaagtaggttttgaatgaatttctcatacttttaaagtacaacattatngcaataacaggactattncacttcttttctaatttggataatggatagatnatcctaagtgtnatangatggctcaacctccgtacaatggtgaatcccgnntcagtngaaatctcggccnggtgtcaaccttgaacanaagcccctagtnatnaccatttngtgnattagcctttggtgttnagtttttcaccttggnttaactgnnngccttaaacctcnttnagctcaagtggacccttccnacctttaaccggccccgnattaagttggggganccatttgggcctttgcngccnaccccnggccccc

SEQ ID NO: 4863 - DNA, 848 bp, Homo sapiens
  misc_feature (1)...(848): n = A,T,C or G
nnnnnannggnttttatnctcngtnnncnntttnnaananggnangcnactggtncgaatgcaggacccacnattnnaattcggcacgaganggccttangctttttttttgtagggtgagagtgggggagagatctcttgctctgttgcccaggctggtctccagctcctggcctccggcagtcctcccacctcagcctcccagagtactaggattatgggcatgagccaccacacctagccaggctttttatattgagttggttatatatgcttcatagccacactttataatattggagtatagtattaaattacagcttgttgtcaagtcagngtttctgtaagacagtatatncaatattggntagagtaacacctatttggtgatacaagatcaacagggtgtctctgattaatttagctcctacatagcccagaagcnagttcattatgatttagaatattgtacatggttatgcaaggaatnatnccaacctatntgtgtttatanggtcagatgatgttcagatttatatctgctgatagngntntnttgcngggaaaacctataaaaccccttcngacttgttanaaacagtgagnaaagccnngattggaaatatttaattacaaccctcgtggnattaaaattttnantttaccattgggaatggttaaaatgctngnncattttgnaanntttgttaaaanccttgnntcctttaaaaacnttttgaaataacccttgntctanggggaaaaaangtatttnnaggcccnaaaanaaatannananggggaaggnggggggattttnccaagtncccccntatgtttggggggcc

SEQ ID NO: 4864 - DNA, 769 bp, Homo sapiens
  misc_feature (1)...(769): n = A,T,C or G
tngccttanggtnncccttcccatgcactcccacggaaangcccncccatcgtangcgcagcatccacatgaacaggcggcgccgaagggatcctgcccctnactctcnttttctgttgaaccatctggaattcacaggcctgtcatgagagacacgatgagaagtccttaaaggtagatcactgattcacaggggagcaggcggaggcaagggtgagtcagtgcttggaactcagtcatccagatttggctctggaaacttctgaagctgtagcctttggggatccctgactgcgagtacaggaagccaacgctatgtggtcttctggaaactcattatctttttcactggtgctatctgggaaaaacagatgaaaacctgaaggtgttctgtatgtgtgctttcaaaagcaaggatctggccggacgcagtggctcaggcctgtaatcccagcactttgggaggccgaggcaggaggatcacctgaggtcaggagtttgagaccagctnggccaacatggcgaaaccatctctactaaaagtcaaaaattatctgggtgtggtggtgggcacctgtaatcacagctactcaagtagctgaggcannaagaatcanttgaacccaagaggccaaagttgcacttgagcacaagatcacaccactgcacttcnacctgggtgacaagaatgaaacttccgnctcaaaaaaaaaaaaaaaaaaaactngacctntanaactatagggagtcgnattccgtaanncngacn

SEQ ID NO: 4865 - DNA, 717 bp, Homo sapiens
  misc_feature (1)...(717): n = A,T,C or G
ggnnttnaaatatcagctcttgttctttttgcaggatccctcgattcgaattcngcacgaggtctangnngatgtctntcnaatcatgggntgtccntntnttttgacacagggccttgncttattgctcangctngagtgcagtnagctgtnatnncactgctgcncttcngcgnannngtnanaatantactctgnntnnganngaannaantanatngntacccnnanaccaactctgtctaaatggaaaagatggatnatnaatcttagncttnatagaacnntgagattntcaannggtgcgangcacagtgctcattnttncatcctatcacaagacncgtntaacctntaaccgtnaacaanatgnaatcgntgtataaaaacaatnnctgtgnttaataggtgactgactacagtagcctttnaggagtccanagncacttattcagcctgatctttccacatacactacattgnattgtntaanattcntanaaattactgcgcnatctanngctttaancctnatgtagtgactgntgctatatctggaagtatctntaaanagtttgctgggnnttnctcactgcttaatcntactagacntatncatctgcctatcntatcacttngccnnnatgattactgcaccggtntacgaaaaatnccattantgattaaacttttaaaggncaangaccatatntnnng

SEQ ID NO: 4866 - DNA, 1403 bp, Homo sapiens
  misc_feature (1)...(1403): n = A,T,C or G
gngacgttgcaaaaagcctggggtttccaaaagccttggttgacgcccatcgcttgganggccgttngcnaacgcnccnacacgcgnnacnngnncnactgagacnagcaanggtgncaanggncagannacaagganggagnctnnntgnacgcgcggnttnnnccgggggnancnangggggggagaacnnnccgggnggnanaatngggcgngnnngcaggacncanngcanatncgaaagnnnccnnggnanccgcagnccggnngacangcgnctgancnnggannnagnnanngagnnaggagaggngngccccanggagannngnacggacnnggagnganagncannncacncacggngcnnaaganagggananncnngnngcaaaggggcgagnaannggggnantnannganagangangannggagnagnnnagngannannggagggncncngnnagtgcatacagagaanggcgacnngaagcgaaaacgccacaananggcnnccnnggngcnnacnnnganagancaacncgggnanncagcnggacgacgagcagcanancgncaactagcanaggananacggaannnggccncantcggcgagnanaaaagaaagccacngcnaaacgcacgnagncacnanacgaccncagnggnncacggggcanacagnncncgacggcngcnnannctaancagacncacagcgcaaaaatgggggagacatgacaannnngacagcganacaccacgacaaacgcgcnggcanancanagcgccncganaggacngacggngaaaccgncgacagcnccacacacaagcncagagaggnnntacacnctagngacangagaggngncngggnaagcgcacgagaacannaacaccgacagagcangagcgnnnanagcaaagaccggacncnagnacgccnanangacacggncngnagacannagagnannagngatgnngacanaacggngccgaanagaagacgnacancgcanngaccaaangnacnnanncaccangagaagaagagnagaacgnacacgnacnagcacgaagaccacngagacntgaccgcgcacagagaagcacngggggacgcccanagaaaanaangagagctgcgcanagagcacagaancacgatgagaacggnccnaaacgantncacgcccaaaacagganannctgggggcanacaanagagagcaggtagncaanacngncgaanagnccgagcanagagacntgggnngnggagnagcagngnnggnncanccagaacaagaaagnnggacagnacngcnangcantagnnanaangnaagnnattnnnggntngncagcgaanngtnaagcggagngnncgg

SEQ ID NO: 4867 - DNA, 1019 bp, Homo sapiens
  misc_feature (1)...(1019): n = A,T,C or G
gnnggnnaaannggcttttaaacatacagnctacttgttctttttgcagggatcccatcgattngaattcggcacgagggccaccgaagagggcaccagtgtcttgtcacctggactncacatangactaatnntgntactggcaataangatctatanaangtcngcnactgatgtgtatgaaaagcatacntgactntatatnctaatgtngggatgtgannttnctaaagtntnacaataattngtgntancatcacatgaccaanngttaactantatcttggagacactgactttntggggccatantnttttgattttanaccaagaacntntaatnatntgtatcccaaatatgntgctccttntgnganagnccaanggctgatttncctntncatcttnnatnnttgttggancacctaangaggtagtnttctngnnggncctngnaaaaantnttccanaanantacccgtgtgcntcnttanaatngantaattgtcnnaaaattaanntaggcnntngnnncaaaannaaaaggcctcccctttgaaaaacaangtnattttgaaanaangataaatcnntntnnagttnatcannnnanannnanatntgtcnaatncnntctanattttntaccnnnntntagtannattcntaaaanntanagaccnttttccctnntgaagnannctntgggcntaannaanntnngntnannnntcancttngncnngtntnnnnnnattcgngtaatatgganncatttnnnanataaaananannttctnnntgnangacnntactanacaaanttttaaantnngttctacancccnnttttananntananantcgnatatgaatttcaatctcccnatnttgttnanataatcaaatnnanattaaattttnataanccttattaaaacctctttnatgaagnatccaattnntgatnaatncntaaacnatgntatactnnnatatntnattatnnantgnnccg

SEQ ID NO: 4868 - DNA, 786 bp, Homo sapiens
  misc_feature (1)...(786): n = A,T,C or G
tgnnnnncgtnagaccagcttttnaacatacaggctacttgttctttttgcaggcatcccatcgattcgcatccctggagcagcttccaacactacttcagggtggcagtgtttggggcactgggcgagcctgccggcctctagatggcctcatctcttccttccacaaactgtctagaaccaataaaaggaaacctgccaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcangttcagggggaggtgtgggaggttttttaattcncggacgcggngccaatgcattgggncccggtacccagcttttggtccctttagtgagggttaattgcgcccttggcgtaatcatgggcatagctggtncctgngtgaaaattgttattccggtcacaaattcccgccacatnccaanccgggggccttaaagngttaaaacctggggtgcctaaagaagtgancttaactcaccatttaattggcgtttgcccnttaaatggcccgcttttcaanttcgggaaaaccttgtccntnccaagcttgcanttaaatgaaattggccaaacgccnccgnggnaaaaggccggttntgccttt

SEQ ID NO: 4869 - DNA, 755 bp, Homo sapiens
  misc_feature (1)...(755): n = A,T,C or G
gntnatgacntnaaactctttggcnagcaggctccctcgattcgaattcggcacgaggaatcttccttaaagtccagagtctcccggannntggagnttgtccttcccaagccttctcgcggggagggaattccttctttctgccgcctgttacatccctgtgtgagaaggtctggtgagctgagcccacatcactcgttctgctgcccaggtgtgcttccatcttcactgtggaaaagtcattttgaactccccggtgactgcaaattaagtaatcaaggacagatgggactgggttgaccattccaaggagtacagttacttgaagaatctggaagcaataccgagcacatttgttggcattaattcattggagcaataatgctgtacgtagaaagtatgttgcttttttaaaaaaacatcatcagttctgagcatttgtagcaagtgaactctaacttggaacggatgataaattcttctaaaaaacaaataaaaaccctccagacaatattatgcattgagagctttaaaaaatatatatcctacagcatttggaaaacactttgtctggctatgccactgcactccagcctgggcgacagagcgagactccgtcttcaaaaaanaaaaaaaangaagacttgnattaatggagaaacagactggtccctggctagaaatnccaaatattgnaaagaagtcatttctttaaaatnaatttatggatttaatgcngncctnagttaaaaatc

SEQ ID NO: 4870 - DNA, 742 bp, Homo sapiens
  misc_feature (1)...(742): n = A,T,C or G
agtgnntttnaananacaagctacttgttctttttgcaggatcccatcgattcgaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacacccctcncccttgccatcatggaaaatgccaatgttctggccccgttatgccagtatctgccagcagaatggcantgtgcccatcgtggacctgagatcttcctgatggggaccatga

SEQ ID NO: 4871 - DNA, 846 bp, Homo sapiens
  misc_feature (1)...(846): n = A,T,C or G
tttnaaatcccagctctngcagnanttcaagtccncntttctaatncttggcanctcgatctcgcncgaannnnntnggcncgagantctgcnctacaacngacaggattgntagaacntnnnnngtcngggggatntngaatantnnntcaacacnngtgatacgcntganctaacaggtggtgttttnantataccnacnnaaatagcangatgcgacaacantcctgnaacngtgtcttntcaaagncaactggcctggaaggctacaagtgtcnnnaaagattctgttcagaatctagccacaganataaaggatggacaaatacctgngacatagtctnctcanagacanccaagccttgaangctcaggtgatgaaaangattntgtttcgaatntanccangagaaataaaggatgganaaaantctgggacantgtcttctcagaancaatcngnccatnaaggttntatttnacangaaagttctcnttttgaatatttgccacacngaataacnggcggttgngaaatctnnaacagagtatnctganaatntgcccanccntgnaangctacaattgaaaaataataanntctgatctgaaatacaagccaccaaaatgnaangattgtacnaatcatncncacccagcagcaacanngacttnatgaaatggccatccannnnggaaaaccanaaggaagctttgnnannaatntgcaatanattacccanncnnacaaggttgaaaaaanccanaattncattnctnagggatggaccctttgntngaccttaaattncagtccntcctcnaaaccnttcttnaagaaggnnc

SEQ ID NO: 4872 - DNA, 717 bp, Homo sapiens; identical to SEQ ID NO: 4865
  misc_feature (1)...(717): n = A,T,C or G

SEQ ID NO: 4873 - DNA, 1194 bp, Homo sapiens
  misc_feature (1)...(1194): n = A,T,C or G
cccccacnnnacncaacacncancaccnanncncnannnnncancaaaaaaaaanccancccanaaacaccanccccaacacncaaacaancccncccaccanccnnaangggcccncaccancctgtcaagcnaacgacccacnacnaagcngccgagaagctncaccnnacacccaaaccncatacagngggcngggcaagcngggnncncatnggganggggaagggngcccggcgcctanccnncnnccnggnnncnacaggngnaccanatnggnccancccccanacnaccangtacccanncnnncacgnnaacaccnnnccaanacaccncccatcnaangcanaaccgaccanangnacctaccnaancanacccnccanagccnacncnagcnncacacccaacccccccanncanggncaccnacngcaaagncccnctcgcnnngatcaccancantnncnaatacancacnancnaccacnccncaaanacnaacgcttanccccancgaccccanacnaaagacccananagcacacacntggnaanaaananacncancgccccccnanncccaanaangcgcncnccaacacancnaaccccanncacccnnaaacccncannncacnggcgacannnggaanacnccccantccccacnnncacanacnaancncnanacacgnnaacncncgancnnacccnnaaanaacanannnnnngcannnanaaaaccccnangncntacnngcacacactcnccanaccagntnncacncaaacgcncacnaccacncaccnccccacnacaccnacgcnccncnacccaccccccaccganacnagcccaaacgnnccanncacnccaangnacannccaagcgncacaccncacacgacncanacccnccnnnacactaacncnacnnnnnacacnnnnccacccacanagcaccanacncnnccanccnagaaccacaccnnaacnacnnanctnncctcnccanncngccnnnntnnccgctcgcanaaacnnancccnccaacacaaanccnaacacaacacntncccccntnaananacaccacnnnaactccannananaancaacnncnnccaccancaancaacacncacnacantacagacnccttanannancnccnccacaaccnccg

SEQ ID NO: 4874 - DNA, 719 bp, Homo sapiens
  misc_feature (1)...(719): n = A,T,C or G
ggtttttnatcacagctacttgttctttttgcaggatcccatcgattngaattcggcacgaggtactttgagtgtttgggggttcaacacacacatgcaattttgcttaacaaaagtgnnntataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcantatnaaatacctgtgatntttctttacattacggataatgcataaggaattaatcttcatatatattatcatccctaatgtagcanggggaagtatttaatngcccatgatatgtatnttacttatactatgccaganaggaaactntannntcattacacntgtannctngggttnntcacatatgtacgtnttcattnnnagtaggtngaagatganactaaatatttncatgaatngaatncctgatgggatagcctcaataagtatttaaaagccngtnttctaaaaataataaagggtaggggtcatttttgacttntgttgatcttttgctattgntaatattnaacaatnnangtgttacatttggtacctggnagncnnnaatgccatnnattgnnnaacancctgaggatgntgaacaagncn

SEQ ID NO: 4875 - DNA, 719 bp, Homo sapiens; identical to SEQ ID NO: 4874
  misc_feature (1)...(719): n = A,T,C or G

SEQ ID NO: 4876 - DNA, 761 bp, Homo sapiens
  misc_feature (1)...(761): n = A,T,C or G
ttgaanctttaatntnnacccctttggaacttnttgcaggatcccatcgattcgtgtagaggaggtgaggaaatactttaatgtgttggaaaccatgggtttgaacagaagatacgcatatggagtggggaatggaaagaaaactttgtgctacatttactgtaaattatatcttattgattcagtaaattcaggtggaatacggaagttcaaatttaaagattacccatggactcctgacctcaggtgatccacccgcctcagcctcccagtgggctgggattacaggtgtgagccaccatgcccagcctcatcattcttattaactggtttaatcctttcaataatcctattaagtagaattattaggtaattagaattaggttaaaaagagctgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtcccaaacattgccaagagaaaatgcaatgtgaggtaaaagatgaaaaagatgacatgaaaatggagactgatctaagagaaacaaaaagactcttntagaccacatggcagtcccatatggatgaccaagcaagaaaagctgcggcaagcagagaaaanaagggaaaccaacaaacatn

SEQ ID NO: 4877 - DNA, 687 bp, Homo sapiens
  misc_feature (1)...(687): n = A,T,C or G
agacaagctacttgttctttttgcaggatcccatcgattcgaattcggcacgagtattggtttgtagaaatgctactgatttttgtacgttaatttttgtatcctgaaactttactaacgtcatttatcaggtcttttggagggattgttagggtttttttaggtttagaatcatattgtgagtgaacagagataatttgacttcctctttttctatttagatgccttttgtttctttttcttgcccgattgctctgggtaggacttcagtactatgntgaatagaggtggtgagagtgggcatccttgtcttgttcttaggggggatgctttcacctttgcccattcagtatgatattggctgngggtntgtcatagatggctcttattatnntgagaggtatgtcncttcantgcctagttagttgaggatttttatcatgaagggatattggactttatcaaatgcttttctacatgtattgagatgatcatatggccntgggnttaatctggnntatgtgctaaacctattcccanatcaaaanaaangatttctnctaacacattctacgaaccagttcacctgaaccaaatctgcaaggcncacancnatnataaaaaaaaatcgctntaaacttnnggnnatactaaaccaactganagnnctgatnagttgncacccnt

SEQ ID NO: 4878 - DNA, 724 bp, Homo sapiens
  misc_feature (1)...(724): n = A,T,C or G
gnangctacttgttctttttgcaggatcccatcgattcgaattcggcacgaggaggggagagaggagggccattacaactctgccttcaagactcatctcttaaaaacaaaacgaaacaaaactacaaccaccatcaaaaccacacgcaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctanccttcttttcacatgtctaatcttttcctttctcatggtgccctccatggaagtcacagtnaacactgaataaatgactagaatgacacgtgtgcgtgccgcacgcgtgtgcntgtgtgtgttcatctgtctgcatgtgggatcaatttcttttagaaaataatttattgnatgatttattttgggagttatattctgattacagngctccttnttccaaatagcattgatttttcccccttnaaagnataatctggtctcaggttggatctttnggacatntctctctctggatgccatgcagttaattaaaaccttgcttaaaacaaaaanaaaaaaaat

SEQ ID NO: 4879 - DNA, 925 bp, Homo sapiens
  misc_feature (1)...(925): n = A,T,C or G
tnnnnannnnntnnnnnnnntnnnnnnnggggnnnnnnntnggntttanactcgggaacgtttctnagcaggnngccatcgnnncgaatgcggcacnnggnggtanccgaattcggcacgagggggacaaggctataaatatcattaataccaggttcaggagtttgcactgcactaaaaatcaactcagctatttgagcaccttttatagagtggaaatggggttgggcagtaganaagagcacttttagagaggcttttntgcagnagncaggggttacacctgttaaccagccataattttttttttaagcggctgtgctgaggatgagccccatgtagttggtgcaggtggggacacactgtctgtgtaactagaaaaactaggcatggccgggcacggtggctnacacctntnattccagcactttgggaggtcaaggggggaggaacacttgaggccngagacaatataatatataatataatatattggccagccttggacaatataaataaagagccctntctgtaccaatttaaaaaactaaaaagcctnggggtgggngggnacaatacnctgtagtccttggcttanctttggggaangcttgngggcaaggtggnatttgctttggaancctacggantttcaattgcctgtnaagtggaagcctntgggaatcgttgcccncttgnnatttccnaccctggggttngggaggaaaaaaacccttntttntacaccaccncncncccccccaaaaanaanttggcccaaatgtggctntnantaaaaggggaannccgaaataggggnttcttngtanttaanggnggcaaaaaagggggggnggntcctgnggaaaaaaaaggcccaccccttttngtgttggnggtngggaaaaantttnaaaancncnct

SEQ ID NO: 4880 - DNA, 1170 bp, Homo sapiens
  misc_feature (1)...(1170): n = A,T,C or G
ccnannncnanccnnannccnaanngannnaccnnnnnnncnacnacnnnancngncnacncnnacnacncncgcccannnacncnacnnaanancnnncgcnnannnanccncnnnnccnncnacactcnnnccnnncnanngnncacccnnnncnnnnnnncnacncnananncccncacnanccccanaacnccngcnntggcanntttnaaatcaaancncttgggnnaacnnccanaannctncnaccaccaccgananncgnacncacngcccgnnnnagcnccagnnnccccaacncncnatcccntncgcncgaacnnnctanccnggggggngggggcgggggcangggngaancgnngnccancccgcccacnccnaccnacacnnccccanacccancnccnnnacnncaancccncncccatacnncanaccgancccnnanncccnacgcaccnccacnngacccgnaancnnaaacacacacncacaccccgaccncnnacaanaccncncacncanncnnnccncnacaaaacccacaccgccncccncaanccnncnnncacccnacgaccacccaacacncccaaccgcncnaancccncaccacnncnccaccncccaccncgacnnanancncnnncnccancacgccnanaccaccnaannnccccnccccnccccaaccaaccnaannncacancagnnancnacnnanncanccccancccccataaaccnaccacacctanncancccagacnanncaacgnccnnnccctacaccgannncnnnnancnanannacantncnacanccacaccaatnccgcagcagacatcgcanacacncagcccncanacacnanccnnaccaccaanacntnacnnacacacacnaacncnanaacnatntnccacgcncacannacaantcnatcnccccacgnacnnctcanncacancgancaatacanancacganacacancnacgannnccanacnccaacncgcgacngncacacacaccacncncancncacgacnctannanacncacanacanncctccanaacagnacncngcncncacagcaccacacgatnacacngnagcacagacncaacncgcgacanaatnncacacacnnacgcc

SEQ ID NO: 4881 - DNA, 795 bp, Homo sapiens
  misc_feature (1)...(795): n = A,T,C or G
gnntttnaannttttaaatttatacancttnttgttctttttgcaggatcccatcgattcgaattcggcacgagggtagactggctagggatcctggacccagggttccacgtagcaacacctgctgagttctctgggttttcttcctgcctcatgtagcccagacttggagctgaagaagctggaaacatggaaacaccaacagctacagaccaaaaaaagtcccaacaaaggcctgtcagtctgccagcctgttctgtggatttccaactcaagatggcagcatcaactcacacctgaagttctggcttccctacaaactttgaacttgccagtccccacaatggcataagccaattccttaaaatgaatgtctagttctagataatgtgtgtattctactggttctgtttctctggagaagcctactaatagatcatttgtcttaatcaattcaagctactgttacagattaccatagactgggtggttaaaactacaaatacttattactcacagttttggagtctggaagtctgagatcangtttccagcaggattgagttcttggtgaacatcctcttcctggtctacagagtactgngttacttaagtggaaaaagtagggtgagctggttcttttggcctcttcttttangggactaattcatgagggctncaccctcatgacctatttaccttccaaaggctccatctccaaataccatcacaatgggggattagaattcaacataggagttttgggaggacacaaacatttagtccttacancca

SEQ ID NO: 4882 - DNA, 789 bp, Homo sapiens
  misc_feature (1)...(789): n = A,T,C or G
ttcaaaccagcttttgancttnttgcaggatcccatcgattcgnntcaaacanagnattgtgatattgtcaaagagaaaaacnaatcctgaagatacatggaaatgtaacctagtttagggtgggtatttttctgaagatacatcaatacctgaccttttttaaaaaaataattttaaaacagcatactgtgaggaagaacagtattgacatacccacatcccancatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacatangttaagcccccttttacaaagaaaaagtnaacatacttcagcatcttggagggtagtttcaaaactcaagtttcatgtttcaatgccaagttcttattttaaaaaataaaatctacttataanaagaaaaggtgcattncttaaaaaaaaaacctttaaangaaaatgaaagaagaacccttttncangatacttactttgangactgttttcccctttttnatgagatatagcttaganatcggcgnggggnatttctttantaatnctctgggttttggatctggccttg

SEQ ID NO: 4883 - DNA, 732 bp, Homo sapiens
  misc_feature (1)...(732): n = A,T,C or G
tcnctntcatctnaacnctttgcaattnccctttttgcaggatcccatcgattcgcccagggccgnctgcctgagcctntctgcagctgctcacnttttgctgaggcctctgccttcagagctagtggggcctgctcacacattccagcngttncctctntatttgncctgaaccaagttgtagaatttaaaggaggtgaagnaaggcgattnctatggaaaatatattgnncttctttactcctcatgctnagtgcataanaatntattatntcccctgaatgttcaaagtggtgtgtgtgtgtgtgtaaaagaaccaggagcaaacaatcttaataggaatgtgcgatcttgcgcctatctttagcacacttaattagctacaacccgggactgtngccatttgaacaaattgntaacaaaatctgccatgttttgctctttttcaaaaggaangactcnaataaccatagcaacacttactcagntttgtgatccactccaagattatgggagcaagaacagatactcctgaaagcaaccctcacctcctnccccgccccctgccctcagcaagtcctggcctgtgtgaactgaagggtttggaagctctggtttctaggagtgcccagaagcttgaaagactagggtgtactagttattgangggcagttgtcantggcagtgtgggggcaccccaattngtattccanggcactgcattgctttttt

SEQ ID NO: 4884 - DNA, 769 bp, Homo sapiens
  misc_feature (1)...(769): n = A,T,C or G
gantggtcgaactnaaccctttggaaantccctttntgcaggatcccatcgattcgaattcggcacgagggccactccgcctcttccctcccttcnttttttcttcctctcccttttttccttcttccttcccctcctcgccgccaccgcccaggaccgccggccgggggacgagctcggagcagcagccaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgntttaccctctgcatctattacatccnaccagtgcagntgcagaaagcataaaccctactgtagaactaaatgcctgggcatgaaacttggaaaaaaaccaaatgtntaagccntgttgaaccttactctcgggatgcagnccacctataactaccaaacatggagnanggaaggaggtttaaatcccccnagggnnacttttnncccantttctaantcgcnancctttncncttnnaaanggngatncntntangcgngnnggccagcanatntcanntgnantaggnnnancccnncntcctngcngangaacnnncncnactcccg

SEQ ID NO: 4885 - DNA, 719 bp, Homo sapiens
  misc_feature (1)...(719): n = A,T,C or G
gtcttgtcctcnnaaaccctttgcacttcctctttttgcaggatccctcgattcgaattcggcacgagagagggtggggtctggccacataggtnnctctgtggctctggtctggggttagacactgttagggactagcatttattggacttgtaaagacagcacctcagaattagtaactacttgcattttanggtctgttntatgaanccaacaagtgaatgtaaaataggctctgcatcttttctgagagccctgtcactgggcagtgagcatttccaaaattgcagctctgtcanaatgaaccatgaatacttaagaaagggaaagtaggaacagggagcagagcaaagcataacttgctgtgttccagggatttaaaaataaattactgtcaagagcaatataagggtcatgggtttgatcangaactttttgtaaatgaaaaagttcacaattnggaaaaaacagtgctagatgtgttatggaaattgttatcacaaattattccactgaaactcaagtatataanacaacaatatattgctgngaaatcttanttntgacatatggaaggtaaccaanaataanaaccatacctttttgcttgaagtgcacggtggtaccaatttctaaaattagaaacatttaagccaaaanatantnaacnncantaccccctcntngaaanaaaaaancctcgnaccnttttgaacttt

SEQ ID NO: 4886 - DNA, 783 bp, Homo sapiens
  misc_feature (1)...(783): n = A,T,C or G
agnaggnntttcagaaagctggnnnaggnagcnggnagangcnttgaaggcccttgctaatngcttggaaagctccatctanagagnngganggtngggagcncgnnaaacatgcngnaacanctctaggaagtgngaatctgatacaagctganatgttgnntnatgganangatcncacngaatggattgctgtgaacacngtgnatnncnngaaccagatnaanatgtnatatggaacnattacancantntgcactgaagcaagctggccaagcangnctgcatgnccgaanattgaatatnactgggcanatggnactaanattaaaaagccanannaantgnnctgcaccaacatacatntgactannnggatgacttgggttcaacgancagncntgatagatgaaacccncgtttccttntaagattggtgtnccatntncccaaaaactttatnnctgtggcaganactatncntaaaagcgncttgnnnagggtttnaangccnntannaatcaccangcnctantgattcngtgatgccatctgccaactaggaggcncanctnaacnnctacnttaagcactnnattcnncnttgnttcagggnntttaancnagntttgataaggcntgaanctgggcacctctncaagaattagtacanaaacttggatnncaagaccnnatnaanggncantctangaacacagnntccncccnngcttaatncattggtagaaccanctcaatngntatccngtnantgnacnactn

SEQ ID NO: 4887 - DNA, 728 bp, Homo sapiens
  misc_feature (1)...(728): n = A,T,C or G
gnnngnnnnnnnngnnnnantnnnnggnnntttgcnaatanacaggctacttgttctttttgcaggatcccatcgattcgaattnggcncgagctcngaccttatnancagcatnacgcatgactaccacctgnatgancaggatgctgagggccggctggtacgctggatcattcncattagtncccgaaagagccgtgcttggcnacagactccgagggtcgttcaactnggctgctgtcccaaacgctgctgaccctgacagtggccatganaccatggngggctcaggtcttactcagnatgagctgacagtgcanatctccnaggagacgactgcagatgccatcgcccgnaagctgaggccttatggagctccagggtacccagcaaagccatgactcatcctttcanggcaccgacacagactcgtctgggggcacccttgctncaagtgtactgataaccnctgacaggcccatctggcacaccctttctgggagaagcatggcctacagaatgaacagggggaccaggaacccctgtggganaggcttaaacctgancagtgcccactctggntcctcntgncttggctgactggnttctggaccatgtgcatttcactggnccatgggatctacatctcttgcatncccanctggctgatcctgccanggnccgttncntcctgctcatggncttnaggnngnctgatcatngaaagg

SEQ ID NO: 4888 - DNA, 808 bp, Homo sapiens
  misc_feature (1)...(808): n = A,T,C or G
tttgttggcnncntagtnannnnggananacntcntngctctanaagaattgggttggtncngcacgangagatgtgtccagtgccccntgtggngtgtgantagaaacncctgnggnnnaagtgactnngtnggnccnnctggcttcgtgcangangnctcgtnactgnatacgacccngccacngtgttctnaangacannnccananatgggttanantcnctgctgtgggagtctttantcccacacncnggacangctggtnanctncactgtncnngatgatgcacacccngaccnatnacgtcangacgatncnnntcncgacanntatggtgaagatncctnccgtggtccnattcttnctgnacntnctgngnccatgacgctcacntngctgtngagctcgntccgtgcccangtgttgnacatntaacagatncnacactgtcttacaangggaccaccnangattngggtctctacaanagancnnacnntgatccttaattattctnagggcctnccgttgnttttggctctgcctggnnttntaggncaacgggacaatccaaccntnnccntttgannanccttatgaacaatttntgnncttcanaattnnntangccntttngnagnaataaccnttttancctnattttgacctgganttnattccnnccaatgccttcggaagntggncctttnncacnaaggggaccaggtggaaanccctcttgatttggaccaaaaaaggccccncttggcttnatctcccttaaactngatnncncgtgcnnncg

SEQ ID NO: 4889 - DNA, 727 bp, Homo sapiens
  misc_feature (1)...(727): n = A,T,C or G
tncttaantggcttggcnactngttctttctncaggnagcccatgcgattcgaattcggcacgtaggtcagacatgaaaactattttaaagctgactttgntgccttatcttgaaaagaatctagataggtgcttttaactggggtattaacttttttagaatgacacagntgaacagtgttaataatagtgtgtcaagattgcaaagtcgacatactcatttggtttaagcaggaatcctagaagcaaatggatggggataagaataggtcattttctattcaccatcctttactattaanggaaaggaaaagaacactagctaaggaagggaaagggaagtgatctcataaaagtagcanccttcattttacattctgtctgttgttcttttcctgctttgccagnntgtgctaatttgggaattgtgtactccnaaacaagtagaaaagtgctgctgagggattntattaaatctttttntaatggaatgtggcncaaattgttcatgttaccaaagcnatatttncntgggaatctaattcaaagttngtggnatacaacctgagccttttcttatntaacacaagaatatgttcacatcttggtatgnggccatatttatngaatgctgaactcnattgtgcaagttgtnctggatgcngtttgtaaataactgaaaataatttggntgacctttttattcaattctgnatagannttaaaa

SEQ ID NO: 4890 - DNA, 748 bp, Homo sapiens
  misc_feature (1)...(748): n = A,T,C or G
ttnctactaattgcttggctacttgttctttttgcaggatcccatcgattcgaattcggcacgagcntngcttttcttgnnancagcagtttttcngnacanatttgctttntnttacaaaaagannacnnaaatgctgttgtnttaacatttcagaacaganattgtgttgatgtgatcagtgtttgggggttaactttgcgttaattcctcaggctttgcnatttaaggaggagctgccttagaaannaaataaaggccttattctgcaatantnggantgaaccaatattctatagaacatataggtacagctgatatcgtgtatatnttccttanagaatagctgaacaccttgagccttaanacggagctgntgggaaacattangcactcttttatgcgtttactcctgcctntgcttggcactgcantcttaaganagattcaaaaggctgcnaangagangaaatctgttcnnggaatgtttcacnggccnataagatgcncnaanactctgtnctcngatgtntgcctgggcccnatgtgnaaggnaggatgcctgctcgttcttgcncctntgcctctnagnacacnatcagtnnncccttcaagacnttccacttgnntaanatatttatnnatgncangganaaggctttaantnnatnnggacaaataatgctttagttttnttttccaaattaggcccttntttaaaaacaaggttggntgnannntccctcna

SEQ ID NO: 4891 - DNA, 748 bp, Homo sapiens
  misc_feature (1)...(748): n = A,T,C or G
ctncttaanggcttggcanntcnttttngcncgcannccaangngnntgggagccactgcgcccggccaangacactttcaaatactcatgatnggatatgcctctgtgattgacagtgagcatttcaaatgggttaaagattgctctgcaaagaggttaactgtngagattgatacaggctatcttcaacatatgtacattgctgtatatgacatttacctaccattgtgcatctgggacttcctgatggaccacaggaattcccttttcttcccattctcttccagatctttcttctacttgaaaccccttatctacaaaaatgaataaacaacccaatctcatttctgatcgngtcctggaattgatctaaggcaangtctggagaagtggtgggagacagcanacagctttngttaagtcttctaaccccagcactttctcagcctcatctgngngttcctgtctcactctgcagacctcacttnacaatgctcttcagatcctttaatgaataggaaattgattttgggtatttctatnaaatacagcagagtcttagaaacttgcagtggccttnanangaaagaaccccttcttaactncctggccagattnatctttcttttatgggntcnaacactaactgggaanttttncccatggganggtatttgngcctttcagactggctttttgnngaactggntttggagggacataaaccgtaggactggtnatantttn

SEQ ID NO: 4892 - DNA, 714 bp, Homo sapiens
  misc_feature (1)...(714): n = A,T,C or G
ttgncnncttaatggctnggctacttgttctttttgcaggatcccatcgattcgaattcggcacgaggtctcataaccntnttngacancaataannnnacgncnagaaccttnnnnaantcggnnaatctgnccatacnccacacgganctaatctngtncnngacattanancttnaangcatgcgagtttnctaanaaggcngttntctttccaaagtggtngccaantttatnacttatgtgnanaattgnttncngatgactgccanaaggcttttnaagatctanngctgtgnaggaagttntntaagaaaatngctgnacnanttgctanatanttgtnngccatatntnatnantgtaccanttgatacttggctgtnccttctataangcatagtgagaanttncnctancgantttnntaaatgctnttcnggtnacattgccaagaatntgttgcnncanaatgnntaataattntacnngatngaacgtctacctaggcttaggactcaagctnnatggaatgctgtgtagnacacatttgtaaccgngnccgacatggaaatngtgggnaaacnganntttcctgngaaananaactcaggttttactttngcaggngcantncnnnatnttntcnnccctacaactgtgtgagcgnagntncctttntcncacttgtgggatacntggntaanncggcca

SEQ ID NO: 4893 - DNA, 778 bp, Homo sapiens
  misc_feature (1)...(778): n = A,T,C or G
agngnntnnnnggttctncntctcctngnaaacccttaatggcttggctacttgttcttnntgcaggcagcccatcgcttcnaatncggcacgagcntatgtnatgctntcacctcccctgtgtaggaaagacctttaactaccagctggtagtngtctcancattcttcaaatagtccggtcttgtttaatattattattattatngttatttaattttattntattgcaactgtacttagagaatagtctggtcttgagaccttttcactgnggtctgntctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcaagaaggccttccccaggaggcctccaacagatccctgaatgccacataaacctcanaggcttggngatcccaggaccctccaggcgctcaagatctccctttgccgtggtcctttccgtcatcacactggccacagtcctctccaatgcctntgtactcaccaccatcttaactcaccaggaaagcttcacacccctgncaactacctgattggcttnccttggccaccaccgaccncttgggttttccatcttgggtaatgccccatcangcatttgccttattcccatttaacccaacannctgggaacttttgccaaaatcttgnngtgaacaatttggctggcctcngacn

SEQ ID NO: 4894 - DNA, 787 bp, Homo sapiens
  misc_feature (1)...(787): n = A,T,C or G
gncaggctcttgttctttttgcaggatcccatcgattcgctagactgctatgantagtgatgancancatctcagnctgccaagggagaacatgantccncatgaacaaantnggttccctgancagggggaaatgnaatgctgagactcacancaggnggtgcgncntanngacctntnnctgnanngananantgnaggccacnatacactngatgannnaatggactnnctcttnaaagtgctggnantgctnctgccataantatagtanatatnacanttgccntggtccnncttctacctnagaatgctgtgtcttacgctctgtcttcccanatctcccannanttgggaanntctgaggtcagagggcaaaangagaaccttttaattctgantctgacataatcagatctggaaccagttgnnaagctgtaanacttatgcangcgtaaggtggttggtggtttaagccntatgntagctgtggntntctaaaanantntgaatntatctctgtcatagngtttgacctgcatttgctaanngngtcnntaanggatgtggngannntggnanttnccccatgcattccnagngtctnggccnntanaaaccnggnccaattgaagttcaacntttaactttnggcctgtanaggaccatttggccatnggtgnccttgtttaaagggaacgaatnttgngaatncgattaagccatttntaatttccctnnttggccttnaatcccccntggaattctttnncngggaacccctttt

SEQ ID NO: 4895 - DNA, 863 bp, Homo sapiens
  misc_feature (1)...(863): n = A,T,C or G
nngtccncctttncaannnctngganacccgttctttctcnanacannaagntctnatgctgnggcacgaggtctcnagttttttttntttgntngtnganacaggctcgctctgncgcccangctggagtgcannggcgcantctcggntcactgcancctccacctcccgggttcacgccattctcctgcctaancctcccgagtagctgggattacggccgcccnccaccactcccggctaattttncggattttttagtngatacagggnttcaccgtgttagccaagnatggtctcgatctcctgaccttntggatccacccacctaggccttccaaantgctgggattacaggcctganccacttgcgcccggcacattcaggttcttatcaangaaataacccagactttaatcttgaatgatacnattatgccccaatgtttaagntnanaaaaatttccttaaaaaggttatctttaaaatnagnatctttanngcnaaaatacccaagcttgatggaaaggccatcttggatgcccttncattcttgtntcaattccatcttcccaaananccaggttcnaaantaaccccctttnttggttggggcnatatgnaaattttttaaagggagttnaattccaanatggattnnaaaccagactgccntgaattgganaaattnntgatttccttcaaaattgtggtttcntttctaaanttggctggncccttaatttggattaatttaaatccatgntattattgattaaatctngangcangatgaaactttaccagtnttggaaattaattactaanttaatcncnaatatntnnaantttttccttgatc

SEQ ID NO: 4896 - DNA, 723 bp, Homo sapiens
  misc_feature (1)...(723): n = A,T,C or G
ttnttnntttcaaatttcaaatnctaggctactngttctttttgcaggatcccatcgattcggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgnggtgatcattgttgtgtatgagaagaggaagaggccagatgaggttcctgacgatgatgaaccagctggaccaatgaaaaccaactctaccaacaatcacaaagataaaaacttgcgcccatagaaacacaaattaagtactgcttacaatatctttangntcc

SEQ ID NO: 4897 - DNA, 771 bp, Homo sapiens
  misc_feature (1)...(771): n = A,T,C or G
gtttannaccagctcttgntcnttctgcangancgatnccatcnatnnnnattccgnncnagggggctgangcgnccgaggacagctcgcgatgagnggncnacgaaggctcntctgnactggnnncanngtnnanngnnctnnctcngngtatncngttcncannctnancgatncatgtnctntacttgatcnggatanaactgtatnagaaccaangnacttnncannngctactgaccntncccatgtncnnctgcacgtagttggatagatancactaccnntnaccagntcgatgaacccgatnngtcctgcagctggtncanactgtctgngcanctnncnncttgcagttgnaccttnnggnccttgttaatgncactaccantgtgctgtccttatgccatggatgttgntcccagatctgtactaacnnctnccaggacatggccaatttgggtagcccctnantgnagatgnnctgacnntganatcactgatnactanatggggctcancgtgatttacatgccactcttggtnatatggtcttantngatgnnanctngatgntgnncaaccttntggaatgacctanatgagctgganccatgaaaganattgncncaagcattncccnntgacggngantatgggctnantncccttattactattnccttngtggacttnttantaanattctgcaaagctcangtccaaattgnatnacctttngnaggcannaccnttcatggntnttgtgnt

SEQ ID NO: 4898 - DNA, 732 bp, Homo sapiens
  misc_feature (1)...(732): n = A,T,C or G
gnttnttnntttnaaatctcangctacttgttctttttgcaggatcccatcgattcgaattcggcacgagactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcaagaacacctgccagcaccaaatcaattcatgctaacttctcatctggagtangtacccacagcagctttcagttaaaatgcatttnctttgggtgctccaactctttgnaactttacangngaacaaccgttttctacngtttcaancccntttattaaacctttatnaggaatgttcttaaaaaaaaaaaaaanaaaaacnnt

SEQ ID NO: 4899 - DNA, 751 bp, Homo sapiens
  misc_feature (1)...(751): n = A,T,C or G
nggagggntnnnnnntnatagacagctacttgttctttttgcaggatcccatcgattcgaatncggcncgagcctgtgtggggtgcgngtacattgcanacgctctagngacctgttgtgatgaactnttntcnatggagagantcactcnngncntancancggnnccggnggatcaagaganacngtgtancnctcngaggatataactnnncaagatntactactgatgcanccnattntngccttnnacntgngggcattacacntgctnntgatgntagntnnaaatgnnttaacagnanncnnccnattcatgactgccgtgggatctaagggaatcaatgccaactgtntacntntggactctnaaagctaatattgtacatggtctatcagtccnggaaatntngcttataatatnnatgngncnttttaatgacntntatnnnnnagatcnctcactttnncnanagggctataatgagattcacgaagtntgcttacnngagagcanacatccggtnatnatactgaaantcctgtggnnatnaaggnttttgaacacttgcaattatttgaattaattcagcncctggtaagaactnccaggaagttcacananagantccattntgttgaaactgcctntggatantactccantgntgnatgctctgntganatcttccanntgggctaccgattnaaggccatggtcaagntnctcacttngcaggnctgaattacc

SEQ ID NO: 4900 - DNA, 719 bp, Homo sapiens; identical to SEQ ID NO: 4885
  misc_feature (1)...(719): n = A,T,C or G

SEQ ID NO: 4901 - DNA, 719 bp, Homo sapiens; identical to SEQ ID NO: 4885
  misc_feature (1)...(719): n = A,T,C or G

SEQ ID NO: 4902 - DNA, 779 bp, Homo sapiens
  misc_feature (1)...(779): n = A,T,C or G
tcattcnnntnctagnncttggtgcgganccntcncttcgnattcggntcnaggtcttcactgntggctggttcccaagcaggantgncgagctctggtcctntcaaaactnaaggtcggcttgaacntgacntagactcctaatgccttgtttgcncnactacngaaccntncnatagacatcgnnnnntcngatngtgacacagncttngncnatcnntatacngnnncngnctntatantaaggnttntnggantntggacgnacgtngtcnagatgnatagactcagactcatctgatgtgatgataagacagaantggagngccngacntganttgtctgcaggatgngtctgaancnnatgtncctgtgtgtgatcttaaagatgtgaatgctntnagncnnatnnccttaatgnntgnnacgagttcgacaagatttgcgattgacttccanactntacncnntgntgntcctgntagatggctntaaanacttggntctccnatgtggtcatatggagaaccccttnctgngncgancnttgntcangcctngncttttcncctggaagnaggntcccactttnggcttgcncaattngggcnaatggcattnncccttttggggngncncccnancttggtnggttnaacnttccntaagggccaanaanccntttnanctcccctttnncctgcccanntctcaatccacctntnaatttcccnaagnggtttntaaaactntnaaaccttttcnanaaagcccctnct

SEQ ID NO: 4903 - DNA, 779 bp, Homo sapiens; identical to SEQ ID NO: 4902
  misc_feature (1)...(779): n = A,T,C or G

SEQ ID NO: 4904 - DNA, 779 bp, Homo sapiens; identical to SEQ ID NO: 4902
  misc_feature (1)...(779): n = A,T,C or G

SEQ ID NO: 4905 - DNA, 720 bp, Homo sapiens
  misc_feature (1)...(720): n = A,T,C or G
ttgcnaacttaatggcttgggganactngttctntctcnaggntgccnngcgtttcgcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaanaagcaacaggcaccattcangaagattacctnagagagctgctgacaaccatgggggatcggtttacagatnangaantggatgagctgacagagaanncctattgacaaaaaggggattcaatncatcnagttcacacgcntcttgaaacttggagccaanacaaaattactgaaaggaacttagctaaanctttncanttccatggcttactctttttacttnttaaaccttccccnccttttanaacntntgnattncaattaatttaanaattttggccntttttttttgggggtttnttnccanctttttncctttgnctttggttaan

SEQ ID NO: 4906 - DNA, 1593 bp, Homo sapiens
  misc_feature (1)...(1593): n = A,T,C or G
ttttttggnaaaaaancccccaaantanccaagggcccttaacctttgggttttctttttttttnggccaggggggaatccccccnatnccggnaattttcccgggaaaatttnccgggggccaaccggaagggaatttnggttaagnccaaaaggttttccaaggcctaaattggggngaaatntggggctctttcnctcatcnanggcactactncntcgctcntaacaanannannntatntanntttntataccttatcanncacaannnnctcctnctacntacgtatacatnttataatnnnatttanctatccatnctactnccctcantcncttataantacctntcctactcctacatatngacncnctgantnttnnctnanacnaancnncntntnnnatntnttctctattanttaaaannntccnnctagtncttatatantatcantacttnntctatnaccgatcacntcntaancnttatctttcntatntacnctacnnatnnccatnattatcgtctnatttancttntnatttactacangantgntctatcatnctcnnatancnacncntctnntccatactnncnatttgacnacngnancatngttgttctccntatncatgntcgtttnatacannactacattatcaatnatntcnctnantattcnaanntacgcantncncatnnctactcannnanncnntacctactnanttctnacnatgtctntgttaactatattaaccgtncgnacntanacatcaagntnacatacntanccnganacataccaaancnatanntaacatatcnctnacttacananngacnattctactacatcaatctacctntctgtaangnaccctttatgatactaccaaaancatncgntctacttctctcactccntacncatacnantnttgcattngcnatcncacgtannnncctacactatagctannnttgntctcnttttntctcactantcnncactntntanatanntantctntctnanngnctctgtngtnaaactccacgcatntacaccgctcnnaanctccctacccanctnnctntatcccttccnnnntnaanntatangtctctatatacnctctncanantnacatctnttattctccnctatgtccctttcaacaaaatacacannanactnactcttctnaacatangacatactncgnntctanantcatcnanntantcananantncntacnnantcancttctttannanaccnncgtatntntcttntctnnnatctntntncnntntctaaatttagttncttncctcncatgtnttancncaanacactntcatncatgcannttcnatacnaatacntanntacatntcatncanntnnattactnaangacatancngccatatatactangattgtaacattcatnannancnncngnatntacacnttattctctatatnatatcttgnatntcacnncttctntcnatctntacnanntcangttnncancacnatctntctnacntcancctccaaaccc

SEQ ID NO: 4907 - DNA, 749 bp, Homo sapiens
  misc_feature (1)...(749): n = A,T,C or G
gnncttngaatttaannccnttngctacttgttctttttgcaggatcccatcgattcgaattcggcacgaggttcctgatatggcnggctatcctcacatgtcgttacattncatcaggattggatggaacatcattcagaggtcctttcacgggcaattttgaggaactgattcatttggaagaaagattaggcaatgtcaatcgtggagcatcccangggacaattgaaagatgtacatatccacataaatacaaaanggttacaactgattggttctcacagaggaaactgcactgcaaacaagatggggaagaanggactgaggaagacncacaggaaaaatgtactatctggtngnctattttagaggaaggtgaagatgtgagacgtcttgcatgtatgcaccttttccaccaagtgtgtgttgaccaatggttgattccaataagaantgccccatatgcacagtggacattgngcccatctgccaagtgaaagntgacaccatgtttnanaactnttgccctccctctcatcccattacttcctgntgctgtacttcaacncnnagatggcatgacttacctgcgcagatttggaagcattgnaacttataatgctgnctntgctatatgggacaacttatgcttagacctacagtttatgtatcaagtggctttgangtnttatnaaagctttttttctagattgacnttttcngctcanttactggttnttgcnnggtc

SEQ ID NO: 4908 - DNA, 789 bp, Homo sapiens
  misc_feature (1)...(789): n = A,T,C or G
ttatnctgtnnnnnttttnaaannatagctacttgttctttttgcaggatcccatcgattcgaattcggcacgagccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacccaattgcattcattttatgtttcangttcagggggaggtgtgggaggtnttttaattcgcggncgcggcgccaatgcattgggcccggtcccacttttgttcctttagtgagggttaattgcgcgcttggcgtaatcatgggcatagctgtntcctgtgtgaaattggtatccgctcacaatttccncacaacataccaacccgggagccntaaagtgtaaancctgggggtgccttaatgaagtgagctaacctcacattaaattggggttgcgctcactggncccctttccagncgggaaacctttcttgccaanctggcatttaaagnaatnngg

SEQ ID NO: 4909 - DNA, 1214 bp, Homo sapiens
  misc_feature (1)...(1214): n = A,T,C or G
gcncttcccccttnttnaaaccntttnaaaacccttggttaaaccccttcnnattnctnatngcttggnactacctnctnnacctnanntnnnnatncacggntngcnnttttcnacgttttnncnnccncttntncactcagcaactttntnacncttaatntgcanctnntctnctancgggnggccnanantanatggnataacanggntgtcnncngactgntcctggccntgnaaatancatctntnatggntaancacannttntccanagcnnaatagnntnggngccnnctgaanccccaanncctnattnncagcacccacctttattattnantatgnnatcataccanctcgannncctatnggtggntntctngngccantgnaatatangccgcagncatntngnntaacgntatcgntgcaacantcnntccaactgnaacantngctcntnncttcgccactnntaatanttncgntcattaccaagtatnanaangntatcttntncacactaantnagcgngcncaaagntngnatnatcactcnnatcnataactnnnantnatnnnnnanggtncaanatcttttntanatcnntatatttatantcnanttntantnnnaattcanntgcttgnnancacatgnannctannnntanntnannncnntatnctctttatngctnttcccntttnnantncanttagacnntacntnncnntnangcgcnnntattaancaacannannnttnnantcanntncctcntnncgattctntcgncncccntcactgccncnnntnntcncntnnctntnccnntnnctnnnnnngtcnnnntntctccttcttcagncnctgtcacgctctnatantannacgtatactntctnctnntannatactcganacacactgntgatatanncttntntacatctatcantacgnncnanatcatanantnntcnatanctctcacactctntcacgatngtntcatcgcaccacttcgnnactcatagatntnnatatanntaccnngtgntantctnntnnatcantaanaangcangcacgacgnacatcttgctntcnnncnatntcnnctctcnatnatnnantnacactaancacnatacncactaactatattactcncatntcancnctactctatgactctanctangcc

SEQ ID NO: 4910 - DNA, 1192 bp, Homo sapiens
  misc_feature (1)...(1192): n = A,T,C or G
gnnaaggggtnnncnttntcttnntctgctttgngtcatcgtcntcgacngngnctcngnctgntctagatgacctctccgctttttttncatngaaaagctcnanacntgtnnctaaatataannctnaagannggacnctanaaanngctcactatacatgctcaactaaacnncccctganctatatgcgctaggngaagcatgctcntncactagacaattgactctgctttagntaattccnattccggaaactcgcgcaacccggtnncctggggacctcctatctcntngaaacgatgaaaaagcccaacccttttagngtcncncctngaggaaatnggcgccattgggcganattcgccctccaaagggaaaanggngggttagacncangnccttttcacccctngggnaggngttgnaagnggaatagggnctcnaaatcccccnaatttcctnngngtnnaaatgggggccacctcngtaaccantcccttgttgggggaaaaatttngccttnattancccttnactnngggnaaacctttnccggaatngttangcaaaaattttttggcttgggggcctttttggggccntaaggnatttcngggggntttancccccaaaattntttcgtnggggncanattnaccaagngnnnccanttgganaccccaattggttgggccctnccccttgggttntnggggcttaccttanaaaaatnctcngagggggcnttaaanccttggtnggaacctttttttggaaaaggttttcnccngggnnttncccntttnaaagggcgttaatancccnggggtcttagtttnggnanaaaanccaatnttnttcnccnaaattgggtttnggggcntttggtatccccccgnaaattnccaattncaaaaaatttcccntggggnnccaattttnccntaanccctttnaaaccggttaaaaacctnggnggggnccnatttnttttnggggntnnaanaatttgcccnaaccgttnttaaccttnttncccctttaattcggngnttnnccccannntttttgtnngcccctaaacgngcntaaccaggggacctttttnggggaaancctttntccatganaaccctttccttaaaaaaaggnggtgncnaccntgggaggaancattnnttggggaatn

SEQ ID NO: 4911 - DNA, 1006 bp, Homo sapiens
  misc_feature (1)...(1006): n = A,T,C or G
gcncannccgannnccncanccannccnnnncnacncccnaaacgnnanaagccgacgccacangnccccgcgancgcccaggctgaancttgcnttcaaaagctggaancgacacgctnnagnncnagcnacngcncgngncacgaggcccatgtncagnctccaagaccnncangacaccgcccaatgggaagcccccgnggncnggaggcgcacaggaagaaggggatnggggcaggaanaagcccanggcccaaggaagaccggaggacccanaaggncaggaagagacacncacgcnccgncncacannnncgcnacaaganacnancanggggagcgacnagcnaacanncacagnangagaagngancaccatgngcgacgnanncacacgcaccnagcgngcnagaatggacncanagaccacanngtgagaannaagccnnagacganaagaacncangngccgcangcncccngagaggnncccccccggcanaacatgncancnactacaccngncnnacnaaggggactcaggngatangaaggcncnacancgccngnaggnaaaacnngcacacncnggaaacnnngaaccntgnaangnnnncncaaaaaaaccncangggnagaaaagagcaaagngcgngcacgcaggggnnncgnaannanaaaacccnngcaggngaaaaccacngggctanaaccaggncncaagngnacggaanaacaacgagcnaaagnnacactaangaaagnngngcgcaacngnaaaggggnaacnanccncangncncacgcangggaaacnancgnnnaccganaaaaggggcaanngagncnccnnggggaaaaggcaccaanaagctataacccgagagcagagnnnanngccccncgccagagaaancccagagnaannangacgnaannaancntcnaanaaacagcgcncaaaangcgtggnacannncaaacancnaacnccngnnaancccc

SEQ ID NO: 4912 - DNA, 757 bp, Homo sapiens
  misc_feature (1)...(757): n = A,T,C or G
tnaatatcagctcttgttctttttgcaggatccctcgattcgcangagggtgttcgactgctngagccnagcgaancgatgcctaaatcaanggaacttgnttcttcaagctcttctggcngngattctgacagtgaggttgacananagntaancaggaaaaacaagtngctccagaaaancctgtacagaaacataagacaggtganacttcgagagccctgtcatcttctaaacagagcagcatcngcagagatnatnacatgtntcatattgggaaaatgaggcacgttantgttcgcnattttaaaggcaaagtgctaattgatattanagaatattgnatggatcctgaaggtgaaatgaaaccaggaagaaaaggtatttctttaaatccanaacantggagccagctgaangaacagattctgacattgatgatgcagtaagaaactgtgaaattcgagccatataaataaaacctgtactgtctagttgntntaatctgtctttttacattggcttttgttnnctnaatgttctccangctattgtatgtttggattgcagangaatttgnangatgaatacttnnttttaatgngcattattaaaaatattgagtgaagctnatngtcaactttattaaggattactttgctgccaccacctagtgtcaaataaaatcaagtaatacaatcttaataaacntttaaactataaaaactcgacccttagacctatantnagtcggttn

SEQ ID NO: 4913 - DNA, 711 bp, Homo sapiens
  misc_feature (1)...(711): n = A,T,C or G
gtnactaatggctgggctactcgttctttccgcaggagcccancgattcgtcnagtgntcgnggnttgtnantntnngccnnggcantnattnattgncnntngatgattgatatcaacanttgaggtaaaaatatncatgaggtctaaatataacatgtaaatgcaatntcatactttatttncattggcaagataacattgantaccnatactgnggtatttgacaaacaagcttgatgcatcgtgatntcnncnttatttcccttttccttgntttaaaaagatgcactgcgttgtnatncncnggnnatatgantactatgngcacnaaaacnanaanntcngatcattcgantagaggganaatcnganctncantcncattcgttctnattcngnngnanggatctngtaggtcctccnttctnagatgtggntttaggccagcagcntaggcatccctgagactccttataaatgcataaatctcaggcncagcccagatnacttggagcataatntgcagtttgcaagatccccaggcaattcatgtgcatgtgaaatnnggacaagcacctttntgggcgatgcaaagccactcatnctcgcgtgcctatnacggtttncaaacacatcggatcccatctcaggagcctgacccgtgtntanctanattaancttcactgntgatcttnatgatgcatatna

SEQ ID NO: 4914 - DNA, 749 bp, Homo sapiens
  misc_feature (1)...(749): n = A,T,C or G
agagnnnnnnnnnttgtcgnntactnaatggcttgggttggttgttctttntgcaggnagcccagcgattcgccgggtctagccaacatgtgactacaactgcatgaaagaccttaaatgagacctactcagccaaactcttcctaagtcctgtccaaacaaaaccatgaaggataagaaatggttattattattttaagctaccaccttttggtgtgattattatatgcaataataggtagcagacactggctttggttggacatgtatgttctctgcatattctgcttttgtgcatgtggagaaatgggctttctgggctgctgacaatgaggaggtagagatgttgttcaggcagatgcgtttagacttcgagtccactttctccttccaagaactatgtggccttacaaatgctggggttggtttaagaaaacagaactcttaatgtttgtaaacattcctgtacgagagttcatccatcatttgngtctctctagaaaggtcatacgcagaaaatgtagtggtgtagcaaaattttaaacttttcagactggcaaaaccctttctttaatgtatagtattactactcatgtccattatgaaccatgacccagggagactctgctganacaggctgcatctnctccaccttatcctnctaagacangcttctacctaaggggacatagaatttacccctgtttgtngggtggtgtggattcttnccaactgncttaatccactgg

SEQ ID NO: 4915 - DNA, 542 bp, Homo sapiens
  misc_feature (1)...(542): n = A,T,C or G
atccctcnnttntcaantcatattcctcacaagcannctntanaatntctnancactttgttctntcncgcnaaggnngacgcgatntgaggactttggtgnnnntgannacttggctgattcacatgccanggcctngnangaagcaggagaaagganannggngacngacttaaacgtgtncaataccatccttaccaccngaagctatccanagcttctcagagngttgcagaantacaccaantacacnaancatgacatgaacaaagntctngacctngagnagaaaggtnacattgctaagtgccttnacagctctcgtgaacngcgccacaggcgaaccagctttctttgcagagaagctctatcangccatgaaaggtgntggaactcnccatanggcattgatcacgattatggntncccgttctnaaatnnacatnaatgatntcanagcattctatcagaagatgtatgggntctncntttgccaaaccatcctgnatgaaaccngangagattattgaagaaaatcctgn

SEQ ID NO: 4916 - DNA, 1285 bp, Homo sapiens
  misc_feature (1)...(1285): n = A,T,C or G
gaaagnacnaaagncagcttgacagggatttnaangnntnggaacncnnnttctcnaagcngnntggtcnngatnanttatanatatgtcttcncatatnangaacnaaantatntntgggnngggnttctnctngagngatttctgtnactcntganttnntaatgcntnananntgtnancgantnnggtnaattgnncctancagcancatgtanccntaaaaacgcatncnatatntcttancncnnagnggtncnncgcnattatctaatgncttcttnaactganntntaanggnctntgtantncgngaanctttaagtnnattcacgncntatattctaantcatgttccaannnncctatcctgcanaattacnctgcnnntgatccntggcatcnnggaagntcantncngnncaattattcatnatattgtggcattnntctnatttnatactancgncntccncntanatatatanaagncngcaanctctgtngaannncttcnaatntgacnnacccgtntattatatgcatnaacccntatcctnatcnanctctagtgtggctcttaggcaccnannatttatgggnaccctgtgntcaaattnggntctccgtnanctnacngctctcnatttaangntnangnctaacntaaccntctttgctgggtacaatanggcgnacnctccnctnnnnacatttttgnnanaaagnctacntgggntcactatntnananctacnccttttatcggtacntngcgtaatnattgnccatatgtgatacgngnccaacaaaatgtcactntatataantntggntcnnacntcnncgttanncnncctatntaacnttcannttttacatananncntaaaacntnttgngcaaacaaccaatnggngatcttnnngaaaaattancatnggtttttnggctacttnnctatntcattnaattaccgnnntatctcnancntanntaactacnnttttnanaaaggngtcaatgggtgtcatctctcagngacaccctcnnctatatancatnctntatntagtataatctcanaaaacnctccctctnaaancttntgggnacntnaanaanacgtgactntcanntcgaanccttgnnnttnttaatnnggatantaggggngtacnaaaaaaannngtgtttataaacncancnnttnaannnnttctctatatgngcaatttcnacggtattnctnncnngtccccatatatactanatcacantatnn

SEQ ID NO: 4917 - DNA, 782 bp, Homo sapiens
  misc_feature (1)...(782): n = A,T,C or G
gnncnctnnttncngcctttngaancccnnagttccaaatgctggttnagatcagctcttgttctttttgcaggaccctcgtcanaattccnacagggaganttcggnnantntttannnngagacngagtctggctcnntngccagccngaggcggganaancncctgaacctgagangtggacncngcgctgagccganatcnttacactgcactccagcctgtcnacagantgagacnntntctcaaagnatgtataatnctnacaannnctccacnngancaaannnnnangannccggannacggagnctcctnccctnaanganccntggaagaatggagncacccagnngctcnatttntgggnntnnncacttnngccgtnaaatggatgancaagggctcaancagtnccctncataatctgccctnaacccntncaaannaacatntnnngccantctnncttcanaaacnggaaggagccccnnatgacatnccagtcnnagcccccancgaggaacnaggccnntgncccnanntgagtgcnagnanaagggcnccctgccanagcccctgccggnnttcntncaanaanggaaagaanangaagcaaccntggaaactcgctctgccaangagcnccnngacaanggttnaaccgggnggcccnnntctgagcttngccgccnttttctgngggncnnccccaagaagtgtttacaccccttaatccccnctttancnctngatttnngggggncccnaacccggatnn

SEQ ID NO: 4918 - DNA, 812 bp, Homo sapiens
  misc_feature (1)...(812): n = A,T,C or G
gnnnnnnnntttnnngctnttgaaaacccctttgtttcaaagaccnagttcttgttctttttgcagggatcccatcgattcgaattcggcacgaggtcacaggtaaaaaaaangtgcgtnataagtnttgttatcggtggactttataaaagcaaangaaattgangtaacttttgattctggtntcaagattcatntttncatacaggtcataactgncttnntgnaaccctttcacagggcactgnnngatgggattaaaggtggcaattactggataactgcacatgcctctacttngttctaaantctangtcatgaggtgatttgatttactttatagangctggattttgaagatctaatgnnaaatgttatgatnatatcagtgngtncaaaaaaagcaccagcaactgataaaaatcgcntntttgtgcgctacccaactggttaaagccaatgtgatcttttatggngaaactcctaaganacangtggttttgctgnaaacttgncanacccttaattatagncggtgctaatgagcctactgcaatataaagccaccattnttttttatcaaacatctgaattcattttacaaaggctattgttagggcattattttgagcatctattttgaggtgatgttnanaaaactttaacntcaaatcaaattgaaaattaatntaaatatattgncttaaggaccttctaaagaatgtgccaccagactttaatggatagttgcnannatccttgnctaanaacaaaaaagttgcttaaacatttcttttacaaganggnttttt

SEQ ID NO: 4919 - DNA, 782 bp, Homo sapiens
  misc_feature (1)...(782): n = A,T,C or G
ttctaatgcnaggttctagtnctgttgaanncccngctattngattcggcacgaggncctggctactggggaggctgatgcccganaancatgttggcccaggagtnaaggctgcagtgagctttgnttgcacngntgcnannncatnctggccngcccanngngncccngccacaccanaaattatgtnctnagtntannngcntcngaaggcctantctcgnaccagagttnctcttactggattatttttagattgttattaacattnctggtctntanctttactcagtctggatnagaaaaagaataccatgcaattgttaactattngatgtttactagattaactattaatatattgttgtggtccatatttaagagttactttgttnctagagatttcattatagtggngnttaatatanntttgggtatttttaactaaaaatcattgctatccttcaactgtagattctactatgaaatgaggaaaaatcagcaatagaattaattgggttcaaagtatataaataatgatgtgggaaagggaagtcngagggtatctctggaagaactgatttatctgaaggtaatactgngtgaaagaacctaagattgtngacanagcatgcttnatgcaattntgctggtccatagtagtantagaggctctataaaatgtgttggggtgtttttgncttttaangagacnagtgtctcgctntattggcccaggagtttcaaacctgnagtgccccngtggnttnncacctgtgant

SEQ ID NO: 4920 - DNA, 781 bp, Homo sapiens
  misc_feature (1)...(781): n = A,T,C or G
agggnnccnntgttctctcctnaactcnnnnntgncagccttnntcgcctaccagaaggggtngggccgcgctgacggcccagntggcgntttntctccattgtgtatatgtacatagnntnnatcactagattgnacnctcctcangggcacgaaccgcaacatntatgcngtgcctgcancncctaatgtgaanngcctggcacactggtagcgtgcatcatgacccntngaatgngngagtaacnacctgccnnancacgatgnnatgcngttcacntcccctgtgnacnncncngcgnngcaantcctgccatangagggcgnagttccaacncgngggnnnactggcncanctgggttgnaccatatcatcccacatccnnaccactngctaacccannntcactgnagattacctgtcagagacctgcgttcgctatctaatattcgngctgaggntcctaggaanatctggaantggggaagattatggagaaaatgaaaanggaaattcggggagggnggttngcagtataaagccctgtgggggaaaacatattttagctcttacttggtaaaaagggtnancagaacctctggtttctttaccaangtccnctggntnggnccatttcttccaattggatgaacnacccctttgggtttttannctcctttnctcaattttggggaattccccnntcnaatnggctttacnatngaantctgggnancttnaanangtcctaaatanaanttncctggggnaatntggtac

SEQ ID NO: 4921 - DNA, 730 bp, Homo sapiens
  misc_feature (1)...(730): n = A,T,C or G
cacgagggctgccagaaactcattgaagnggacgatgaacgcaaacttcgtactttctatgagaagcgtatggccacagaagtngctgctgacgctctgggtgaagaatggaagggttatgtggtccgaatcagtggtgggaacgacaaacaaggtttccccatgaagcagggtgtntngacccatggccgtgtccgcctgntactgagtaangggcattcctgttacagaccaagganaactggagaaagaaagagaaaatcagntcgtggttgcattgtggatgcaaatctgancgttntcaacttggntattgtaaaaaaaggagagaaggatattcctggactgactgatactacagtgcctnnncgcctgggccccaaaagagctagcagaatccgcaaacttttcaatntctctaangaagatgatgtccgncaagtatgttgtaagaaagcccttnataaagaangtaagaaacctatgaccataagccncaanattcagccgtnttgntacttncacgtgtcctgcatcacaaaccngcggcgtatttgctctagaaagaagcancgttccctngaaaaaantnnnggaagaaggcntggangaatattgctanaacttnttnggctaagagnaatngaaangatgcctaaanggaanaagcnccaaggaancaaaattggtnaaagnagacnncnnacnttttcctnttgtngcnaagcnn

SEQ ID NO: 4922 - DNA, 675 bp, Homo sapiens
  misc_feature (1)...(675): n = A,T,C or G
gngnngnnnnnnnnnnngnnagnnnnnnnnngnnagnttnnnagngnnntttntnatacagctcttgttctttttgcaggacccatcgattcgaattcggcacgaggcnctcctgacnacngccaagcactntnncggnttccgngtnntcnnttgcagntatngnaaantnnnncattcgtnnnnactggnnatangnntntatgaatacnanatgtnggacttcatnatgntcacaccnatagcatcntatganagaattagnngncncagantttacnacanagtanatgtccnnngtcatgnacgcagatatacacaattctnaaaagtttacctnattcagntgcacgacttggatnaatggactggcnataaggattacatagtnangactgtcacaattntnanagccgntcanacctnccagttcatggagactgatntgcncanagaagcactgngcttgcancggggtcnatgtgcgtctgatatntgaccagnaacgnncaatagcttggtattaaaaccncngcaatgtnngnntgattatgacactacnaatgttgtnnacacttgtacgctacacatnnnctaccttacnaatatntacttgtattgntagagggctntccanagaaatnntnntatataccgaatgcaacacctgctacg

SEQ ID NO: 4923 - DNA, 675 bp, Homo sapiens; identical to SEQ ID NO: 4922
  misc_feature (1)...(675): n = A,T,C or G

SEQ ID NO: 4924 - DNA, 750 bp, Homo sapiens
  misc_feature (1)...(750): n = A,T,C or G
cgggnnnnntncntttcntcctaangaaacncttntgantggcntggctacttgttctttttgcaggcacccatcgattcgattcaaggcctctcgagcctctttaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggttttgcgtattgggcgctcttccgcttcctcgctcactgactcgctgcgctcggtcgttcggctgcgcgagcggtatcagctcactcaaangcggtaatacggntatncacagatcanggggataacgcag

SEQ ID NO: 4925 - DNA, 1302 bp, Homo sapiens
  misc_feature (1)...(1302): n = A,T,C or G
gnccggcgccagtgcngtacccanagcagaacgacccgtaaaaccccttgggaangnccgggacgggncncnngngccgnnccncacncgcncncnnnacaccccnttttncccccattttancaccannatngncnnancangggggngnannacngngnaaaacccnggngagnncccnnccgcngggganncanangngcngnnaagnaaccnggngcnncaancanccngngcgngcccacanacacnggccanaagananacgcaagcgnacgcggncgaagncgggngnacagnaanaaacnnncngcacngcgnaaaangccgcncaacannagcnaagggngaacgngacacngccngancncncgncgganncacngannnncgcannancgcacangagcgganaccacccagcnngccanaangcggcacanacgncncggggnnnncnanccgngncccanangnnnagacncnggnacacccnnccaccccnangccnagannncanaannccnagnnacccnagacannacnnnnngannnccnnncnanccgaggnacannncngnanngnngacccnnnnctnnnnngccnananannccnnacancncccccanccncccgagngaaacncnnnaangaccancncaanacgacnccncgacannacacnngngcccancnaanncaacacnaagnnnaccanacngcncnncgnacnaaacnncacgcncgcggagcccgaaccaacgcacgacacgcgacgaccgancancaagaangngaccncacacgnagcgnccnnncgcgcgnancgccggacncanngacannccgaanaganncgcggnangngcacgaancaacggccannngnnganngaggagcnacaaccncnacggangcgangccgnanagangacggaccaagacnngaanaccgncgaggccnaacaaacggncgacgcccgcggaancncacnancncngnnggncanncnngacccnganancacacancgcncaccacangnnngnggaacacgacaangccacgnacanaacgacgaagcangaacanagnngncgcaanngnnancnagnnnggaanacacacncgaaccgaacacanacgaagnaanaccaagagcannagnagaagcnnacacagacacnaaacngnaaccggcccnnagnancccancgcncnngcancagngcacaanaanncgganncccacgccaaaacngcnacagnncgcaacgnangncncnacgccanacgcc

SEQ ID NO: 4926 - DNA, 818 bp, Homo sapiens
  misc_feature (1)...(818): n = A,T,C or G
tgnnggnntagatcagctcttntctttntgcaggatccctcgattcgaattcggcacgaggctatttgtgttttgttgcactgttntttttgtttgtttgtttgtttatttggttggctttttggagagggaaatgggggtgaaatattnctttattgntgaatcattttgtgaatgtccccctcaaaaaaagctaatggaatatttggcataaagggcattngntggttctatttttgtttgaggggnattntcagaaaatcccttttctctcttacgcctaactgactngggaaccattgangatntncntagcnttggaatacttgacattatntactctnacnaataacacattaagcnagaatnaccaatnttccnanaatnngcncttgatcacaaaatgtgannnacctntnaatgtntanaactttatcaaattnagtnntattttccccttcnaaatgtcnccctttcccnggcatttncttccnttaaaatattggtnanttccctgacataccnatttccatngttcaacagctttgtnnccnnagntataanaantttttgnanccctggananattttcaatnncgccnatnangtanccnttcnancantgttngngnaaaacccccntngcaagcccntaaaaangttaagccttanttgnctttaattncnctttnnnngcntnactaannccncatnttcnnanttccttnaaaaatcntnttnggagcccnncccttntnnttacctttgnantnnnncccaaacttcanngnntatccaatnctgntttnnccnaaacn

SEQ ID NO: 4927 - DNA, 742 bp, Homo sapiens
  misc_feature (1)...(742): n = A,T,C or G
atcagntcttgttctttttgcaggatcccatcgattcgaattcggcacgagggtgactgtggagggcgagctgagccctggccgccgtcacaatgggccgngagtttgggaatctgacgcggatgcggcatgtgatcagctacagcttgtcaccgtcgagcagcgcgcctatnccacgtnttcactaaaggaatccccaatgttctgcgccgcattcgggagtctttctttcgcgtggtgccgcagtttgtagtgttttatcttatctacacatgggggactgaagagttcnagagatccaagaggaagaatncagctgcctatgaaaatgacaaatgagcaacgcatccgnatgacggttccctgtctctgaaagacctttctctggaagaggagtctgcattgtntgtctcaaagacacaataaacttcctatggtctgcanaacacannatntnttaaaaatttaaaaattanctgggcatggtggcaggtgcctgtattccactactcangangctnangccgaaatcnntagaacccnggacgttgaagtttcagtnagctgantcnttccactggacttnaanctgancnnnngantgtnactccatcccaaattnnaaanangtgggantattacttntcntgaaacntgcgcctntangccaattcttaannnnttangtggnaagaacatttancccagnatttnaggttnnntnacnatgctgngggggnnn

SEQ ID NO: 4928 - DNA, 760 bp, Homo sapiens
  misc_feature (1)...(760): n = A,T,C or G
aaccgggtgggccccttttttgaaaggntttttttancccttngttnncncnnnctaaatanngnggntncatcgcntcgctanngccngntntgggangcnatgntatacttggctaccttcctatgntccttctcacagcaaaactnngggactgatcatttgaagtcacccctctgtgtcttcttgtgaaatggcttgggcgtctctgggctctgacttgctcatctgggaagagatggggtanagggagttggattataaatcatgcttcactcagtcaacagaatgctactcaggcactaaaaatgatggcgtagccctacgtattctgacatgggaagatggccacaatatcttattatgtggaaaaaactagttgcataggatttatggnttgattacattttagtaaaataaattcatttatggtggtatatgcaaagaaaaaataatgccgggcgcantggctcacgcctgtaatcccagcactttgggaggctgangcaggtggatcacttgaggccaggaggttgagaccagcctggccaacatggtaaaaccccatttccattaanaatacaaaaaattagcaccaagcgttggtgggcacngtgcctgtagtcccagcttactcaggaggctgagatgggagacttgcttgaacctggaaaggtggangttgcggtggagcccaagatcacgccactgcacttcggcctngggctacagnccagactctgtcntcaaaaaaaaaann

SEQ ID NO: 4929 - DNA, 887 bp, Homo sapiens
  misc_feature (1)...(887): n = A,T,C or G
gngnaggnannatttnnaganagcnnnngnaangtttggggtnaagagncattnaaacncttggcnncaggnatcccaangtngcnaattnggcacgaggttgtnttggaaacagtcgtgnggangaattgcgagagaacctaaacgggatctnctgtggnttgctctggatganatnganttggctaanggtagaggaacatttccctgggatatttnngcccttgatattcatcaagatntanactggaatnctaacgcncctaccctgaatgtctggcctntgnatatctgtgatgatngtgcggacatatttcancgggatanaacagncgaattaatggaattgacagatgagcaaagaaatgaactgatgaaaaaagaaagcagtcgactccagaagactggacatcgtgtancatactcacctcgtaaagagaaagcactaaaaatatatctggatggagcaccaantaangatcctgctcaagactgactctgatagttgtagcanttttcccttggggggaagttnnnngtttttnaanaaggatgggttccactacccacttggggaangttgcccattttcnnnccggnaccaatgngnnngnggggtnaacccncaggngaacnaaccantcgccttggaatgggnnacctngnnnccttancaancctcttcnagaaagggcnttcnagtgggcccccaaanaggggncccanntgggtcccatngaacttggggaaatccannggntttgannccacccaatnagngncaanaaatggtcccngggaaaaatntggtcaataagggggattgaggccntanatcaantttncctnggcnncccaaccntaaaaaaaggcttnnccgngatccc

SEQ ID NO: 4930 - DNA, 804 bp, Homo sapiens
  misc_feature (1)...(804): n = A,T,C or G
tcncccccntttgaannccctttntttaatnnncatanagctacttgttctttttgcagggatcccatcgattcgaattcggcacgaggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaaagtggccagaggattgaagccaaagctaaacgagtgaatgaggtgatcgtggggaatgaccanctcatggagatctgagttctgagcaagtcagactccttncttttggcctncaaagccacagatgttgggccggcccacctgtttaactctgtatttatttnccaataaagaaggctttcaaangcatgcttgganacttgtggagcagtccaaacttcatgtcaggtgggcttccagtgtacacaaaaaaaaaaaaa

SEQ ID NO: 4931 - DNA, 887 bp, Homo sapiens; identical to SEQ ID NO: 4929
  misc_feature (1)...(887): n = A,T,C or G

SEQ ID NO: 4932 - DNA, 807 bp, Homo sapiens
  misc_feature (1)...(807): n = A,T,C or G
nnnnnnnannnnnnnngnnnnnnnannnnnnnnnnnnnnnnnnccnnnnannnnnnannagttgaacgcangaaagccgtggnaaggcgggaaccaaccgaancgnggaanggcnataacaannagnggatgtgnccagnnctctgnatctnngacttngatgctanatacatcatgncatnngnngctnctaagggaataagccatagaggctncnccaggtagaaaagaacagtaaagnacctggaaaaccaacattnnngaatgnatggacactggacatgagatatgnacaatgaaancttaaaagaatctaagaatnngccctctttgccccactccacccagnaatnagacattactagngccatgtataggacccaactgagtattagaatcagnnnngactatgncnnngnatngcctaaatctgttaatgcataaaccgaatnagggtccagnnggcctgtnaatggtaaanntacatnanaaatgactcagcnngagnatncngggcgagtnngcaatgngataatcagatngggnaaaactgatnaatnngcaaactngagngggngnacncacagacnaaagnangaaccacagnnaactagggggaccaggnggnaagnggaaaacacncacaagngannnnggnnnngggnaagggngggnngaangganggaaaangngnnnnaggagggaagcaaaacnnaaangggncnggaaccaaagccngnncgnaaagnaaaannnngggcnggaagaagggggnggnaaccgcaaaccanngccnagggggnnnc

SEQ ID NO: 4933 - DNA, 925 bp, Homo sapiens
  misc_feature (1)...(925): n = A,T,C or G
cgngctttaactnttnaaaccctttgcacttncnctttntgcaggatcccatccgantcgaattcngcacgagagagggtggggtctggccacataggtttttntgnggctctggnctggggntagacactgacagggactagnattnattggacttgcnaagacagtccctcanattnagcaactncttgcntnntatggtnngcattatgaagccancntagngnnngtaaantanagccctncatctntnctgngnagccccntcactgggctngatgtcatcatccaaaatctgcanantctgncacaanganccatgantacttaannaaagggaanntctngaacnggntagcaagatcnaancatancttgctgngctnccanggnacncnancctnanncnctgncnannngcnatatanacggtcanggggctttgatccangaactctnntgtactatgatnanannccacaantntgnnaaacctncatgtancctnnanagttgnnnntgngcanaatcgtnctcaccaanantnntcccnccgannaactctaacttntnattnannnctaccngtnantnttnnaatgtnnacaacnnctnnannnccntccnnattctaaggaaaangnntctacccctantanatagnntcagcatccactanacnnctntgctngcctccgatcccactngcncgcnctntgtntnnngactgcccccctngnncttnctctngananattcttnggatactacccaaatattntgggnnanctactgcacatctnntcanntnnnncgcatntcatnatntatantcancnnnncnaatncncnngctnctncttacnaanantncncantcgcggcggggcgnncncatantannncngnnncannnaaagnngcg

SEQ ID NO: 4934 - DNA, 1025 bp, Homo sapiens
  misc_feature (1)...(1025): n = A,T,C or G
gttntcattnactttcntaatnnnntgggantctctgaangacncnatngantngnnttcggcacgagtactgctccttcattcccaagtaagaaangncaggntctgctacttccaaaactcagncacgacttgaaggtgaantgactcctaattccttgtcaaccagctacaagacagtgacatctgncattaagctctccaaacataaagctgaatctnactagccctaaaaggggtcagaatagataagaaaggtgganagaagttgtncnaaggncatagaaatngtctgntccagcctcantggtgtcnaggataatggcgangaggaggatgcancattcacttgcaataccangatgtttactggancccatanttnatgtnggattnanacnaataangataangaaatgggcnaangaagaattggatncancaattanagggggtcggnncaatgnaantcatacnangcantattgctaattttcaaacnttaattncaaatgcaacattcatntnctaggatncctggntttnnngtaaacttnggtaanaaactttnggattttcctnaanannanttcaatnnttcatnatancatcccnttngnacnaggntactcctaanaatncnaatttnnattgcnctaaaccnttntnctcaantctnggggannntaatgggnntcnccntatantagtnatntgaatttttctaagatcacanaaaaaaatgggccatttgtctcacatntatatggnggatggcctctccntaaaacntccttnntggggtanaataccttttnncncacaangngcttacatcnctaantcntctnttgttatatactnatacacagtatttnctctaananctnnccgngnttctaacattntcnaaannnctctttaaaaattctntgnanaaaattcgtngnctcncnntatcatcncnanttnataatnctngtantnattctnttcannnacaaaatacgcctcncgntngntcc

SEQ ID NO: 4935 - DNA, 750 bp, Homo sapiens
  misc_feature (1)...(750): n = A,T,C or G
antgangnnnntttcnnagagncagctcttgttctttttgcagggatcccatcgattcgctgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattggtgcatccctacttcttcagtcaggtttttttgtgcttacaatttgtgataactgtgaataactgcttaaaaattcacccaaatgggangctgaattttttcttcagccaaaagtaagttttgattaggaactttggttcaacccn

SEQ ID NO: 4936 - DNA, 1500 bp, Homo sapiens
  misc_feature (1)...(1500): n = A,T,C or G
cgcccttgtccaaaacggccttgngncccaaatcagtcttggaaaancctcaaatnctctctanacagaatngnggctnggggnanncnncnttnncatggnncggntttatctcnactcnttttttatgaggctctttttttcnatctctangannccttctaacnggnantanncactcncggggngnanctcnnttcgngggggntnnactaantcaannntgnnnntctatanatntttanntnctnnacatnccactcntntantcctctgnnnatnccnaacatnnatacncntcacccntttacnctancncncannacanatctatctnatcactcngnnnncnnnaantcggccacataatcatnctnctcacnnntactantncntcattctcnacnntctctnttctntacnatantntntanctcctntttctcntnttcctctncncncanttctctancnctgcctaatanacttactnnntctcctcnntncacaagtcngtacntccgtctccctntnnatnacanactatntnctcntatnnnacannncttncatatnntnnnatnttnnaccnntncantcnnttacntntccctnncantagntctantctnctacnttactctnntnatctnnctnttcanctantnntcacanttcanntcctatnntngnccntctnattcanntcntcttatntcngnacantctnacncannntctccnncntnntntcatanctctntnnacntntaacctactantcttnnactctcgtnctacctactcncnctntantgntactntacctcctantaatctatnctctctngntntnnnacctcacnactnctctatacnnncgatnanagntntnacaatntctcgntagttanangtnncgcgncctaccnnnataccnntntncnttnanactactctctctctctaancnctctgctcntatactatactcnatcnatatgttnatncatntctctcncnntnanncgtngttntntaccctctntntatctntncnncngntcaacnnncttntnacatnncnttnacncatatnnatnccgntaatctacatncngctctnctctntncctcacatacgctccncnnantcatcttctnatattnaatgacacntatntcatnntacgtnttntgntantttaatcnctttccataatctactctcttatnctannngctctcnncnatanctatnctcnatatnntaactctcnnnnncactacngatcctaatgtnttntctnncnntnantgatatctanaatnnanntcttttncnataaactnnangcctctctaatncgacagtctnctctanatantanganaccaanatccatacctntnntctttnanatactntcnattgactaactncttnntataantacgtatcnatnccanatatcttgcntctctntttcncncccccgc

SEQ ID NO: 4937 - DNA, 812 bp, Homo sapiens
  misc_feature (1)...(812): n = A,T,C or G
ttgtanctaatgctggttggtcgttctttctccangaccnagcgnttcgaattcggcacgaggggaaggtctggctccagcttgagcccactcacaggatgtcagggggaagtgtgactaaggtcacggccacgccacgtggtgggccagctggatccagagcaggggccgttgtggccacacatcctgagtttccatggtctaatgcantgggcttgaaaaaaaagggtggatgcaggatgctggctgggactgtggagtgcgtgggcagtaagtcttaagtgacagtgggtggagattacagcatttcatctgcttttcctttgacaccttttaaagatacaacccacagttttcaagggtttatgccaatgtctgctagagggatcttgcagtagatcttaaaccctatagtattcttaagagcacaaggaaattcttatttgggttccatttacaacaaaggtggaaatttaaaactaggcttganatttgaaatgctggtcacatttaancantttatttngggggggtaattttttggaaatcngtctttaantnanttttaaananngttttnccncatttttnaaaaaggggntacctttncantttngntcctttcaannttttnnnttttggnnaaaaaatnttnnnngnttnaaatggaatgtttttaaccagggntttggggntttttnaaaanttttnnaangggnnntatntntgggnnccttntnnaattccagnttnntnccannnttngaantttnncccccttnntngggnaaaaanggnnattgntttttttn

SEQ ID NO: 4938 - DNA, 783 bp, Homo sapiens
  misc_feature (1)...(783): n = A,T,C or G
ttgaaaccctttgaaacctttttgcaanctacttgttctttttgcaggatcccatcgattcgcaaatacctaatgcatgtggggcttaaaacctagatgacgggtagataagtgcagcaaaccaccatggcacatgtataccagaaacttcacattctgttcatgtatcccagaatttaaagtaaaatttaaaaaaagaaacgtactggaaaatctgaatagaccctctgctggaagcattatgaaaagtaaataaatggatatactgcatcatcctcagaaaaaataaaaaagaaagaaaatgcctgcccccttctgcccacaaaacagattaagcaggggctcattgttggtgtcagaagagttgagtgtaatacactgatggtatgcacttgattttagaaatatcttactggtgacatttctgaaaatttgccaactcataattttaagaatttcaaaatgtaagtttttatttaattgcatttgaattctactaattgcatgtaattttttattactaattcagaactaagaatataggccttaaattcctcctaaattaatgtgaggcatttttcctaattcattgtcacgaattattatgaangtcatctgctgtattacagcagtccatactcgattgttccttctgtgtcttcagataggttctttttcttttcctgtgagtatgtaaaacagcaaaccaagtagatgggcttattttggtacatccatacngaggaattttatgggcttattaaaaggatgcttacaggagat

SEQ ID NO: 4939 - DNA, 1150 bp, Homo sapiens
  misc_feature (1)...(1150): n = A,T,C or G
tnccgttnnnattnnntgtgaacccnttcttcncacctncctggntgngaatnctgcacgagaggcattgnctgccttcggctttatttctgctgactanntatctcctattnagagctacggcaatgcccaaaagaaaggctgcaggtcaaggtgatatgaggcatngagccaaagagaagatctgccaggttgtctgctatgcttgtgccagttncaccagaagtgaagcctnaaaagaacatcaagttcnaggaaaatgaagacnaanagtgatntgatggaagaaaacatagattcnagtgcccaagccagttgctgaaacccaagcnagaagcaagttgttgaagaagactacnatgaaaaatgctaaaaaatnggagaaagcccnaaatttcnagangcncccagctttcttgaaaaaaagaaattgttgggaanntttaaaaggaatgaanaattatttgaacgattgcccccnannaanaagggggtngggatgaattaggaannggaaancccgttnnccatgcngcgaaantttnaaananatnggtatcnaacgaattgcattctcnaannggaaagttttgcantnanannattcnntanaccgnaaatnatcaaanggggnnngaaagccctttggtaannaatgtatgngtcccttntnggnttgnaaaaaaaaangggngggggaaatagtaaagtnnttngngtaaaatangntaggggatttntcaacnaatttngngganananattggnagggnaaanaanggngcncnnataactaaattgcccnnantatggtnaancttanntnntgtnntngnatanngngggnnacnntatatttaaaanggggcgtgcgnanattgaaccngggggtanaaaatatggggnaaaaaatttgggggaatataaanntantttgngtatanaanatcnnttnntnananaggggggtcttatangggattnngatatcaatnntattnatggtgcaatgtntaanancacnctcgnnaaaaatcgggttaaanaccnnagggtcatganatntngtggnannatncagntggttaaatttngtanatatattttgggngtaananngtcttgcttaaatngggnntaggtcatttcc

SEQ ID NO: 4940 - DNA, 991 bp, Homo sapiens
  misc_feature (1)...(991): n = A,T,C or G
ggnnngccgnnancnggaccntcancgatntnnacnntttgnnaaccccccccccgagcgcgggcggngagcnngtgatattnngannagatggaaacanctcnagttgnngccttttntgtcaccnnagtgcgagggggngnatnggtnnnaananacntcnctnccangncctncnttanancacccatctaaancacaaaattcntgaagnggccgntcagtnnnggcanacccggcctccnagntatgtataccctgtctgttcntatngggatntntnctccatgtgagatatangatgcgtgcnatncgtaaaaggnggtgcnagtgctncttgtnaggncccgacacattangcgcttantccnttaattagnganccttgcntcangggaaangggcttttctatngaatggggaataanataatgggntannnctttttttnaanctcccgagctcnantaangntgcttaatggngcanctacaatnctccganacttccaatgtgggttgtcnatanncnacccttnnattgncggggtggtccaaaagaantgcaaattcctacctcttgggcccatccaaangacccctttcaaccatgncnctttntcgnncggggagagaaacnatnnccnggggggtnaaaaggcctcnccccccntntnttttcaccccaanagggggnaatananangttctanctccntatnccttttccaagcctatttnngttnggggngggngttngcnntntctccaatangcccccaaagnattttcatttgtttaananttncccnacnttccttgatttttaaaaanataaaaatgttcctnntaagangaaagggnngnanttnntaaacnaaagcnnnaagaaagnagaaanncctttttagaantttnntanactnttcncaaatgnnganantacctnattcggggntggtnnctnntnatnttggttacgantggctggc

SEQ ID NO: 4941 - DNA, 1075 bp, Homo sapiens
  misc_feature (1)...(1075): n = A,T,C or G
cnnncttcncctcnntgaaccnntttgnaaaccncccntnatgcaggatcccatcgattcgaattcggcacgagggctgctggagctggcaaggtcaccantttttgcccagaaagctcagaaggctaaatgaatattatccctaatacctgccaccccactcttaatcagtggtggaagaacggtctcagaactggntngtttcaatnggccatttaagtntagtagtaaangactgggttaatgataacaatgcatcgtaaaaccttcagaaggaaagganaaatgtttggnggaccactnnggttttcttnnntgcgtgtgggcanctataaagggattagtnnncaaaaatcagtacctttttaatgggaaaacaacttgacccaaaaaattttgntccacaagaaaattttggaggaccccattnaanaangagnttaaaatngaggaaaaanaaaaaacgngcntnagagaaaacttccggaggcccctcttaagaacctaattaggtggaggatccgnaatttnaccggncgggaatccccaagaaccaatgggaataaangggattacccntttnggattggaagccttttggggacccaaaaacccaaccaaaccttaaggnaaatggnccanntnggaaanaaaaaaaaatggcccntncaaatttnggggnggnaaaaattnanggnggaatngcctaatngggcctttgaaatnnnnngggnaaccccanttnattaaaggccngggcaaagtnnaaacccaaggnttnngacccaaaccaancccaaattgggcaatttccnatntnnnaaanggntnctccanggggnttccaacggggcgnaaangnnnnncnncnnacnnnnntnnnncaannnacnncnancgnnnnctnntacannantnanaannnntnnnnccnncnnnncncnccannanccncnnnnnnnncanacncganannncncnnnnncgnanannannnccnnnannaancnncatctnannnacncaannannananannnnnnnnnanncnnannncnnnnnncnnncgncnacc

SEQ ID NO: 4942 - DNA, 741 bp, Homo sapiens
  misc_feature (1)...(741): n = A,T,C or G
tntttccttacnaccagctactgntctttttgcaggatccctcgattcggaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgangcgggcgaatcacctgaggtcaggagttcgagatcagcctggccaacatggtgaaaccctgtctcaactaaaaatataaaaattagccgggcgtggtggcangcgcctgtaattcccagctactcggggaggctgaggcnngagaatcactttgaacccanggggcagaaagctgcagttagccanaatcgcctcattgcactccancctangggacangagcgcgn

SEQ ID NO: 4943 - DNA, 887 bp, Homo sapiens
  misc_feature (1)...(887): n = A,T,C or G
annnnnanngnntnnnnnggnannnnncanncnannnnnnnaggnnannnnnacnattcncccctttcctaanagacttggcnactcngcnctntccgcaagnagnnnngcgttnncggttgngaggaaatccaaagctgaccaaaacatggtccccaccttttggagcttacagtctgtactggggaacagagattcagccaaagtcaagaaacactggatgccagctagattatctgttctgtgcttnggtgtctataagtacatatgnggatatgggttcattnnatccctaaacttagtaccaaaccagcatttaatatctaattataaatctaattnggcctaaactttattattgcacactgcctgaacaaaacctatttgcctctatgtaaattttttcctcatggaacaagggngngaaatgaaaatattntaggatttattcaaaaacagactattctgntntcagctncagaantgnacnatgaatcctaaggaaccntctgccaacangttgaggtntgctgnncgaaaagaaagaanaaagaggcggnaanntctcagggagaaantannnccnntncttttctatnttcagcanaccntggaggggtgggcgagaancaagaantgtaaagggaggatcagaaaatggggaatncttnggcagctgtnngaanatgatgangaagaanctcnnnantctcagttncccntnngnttccctatnaactnttggataaaatnngggnttnggccaccaaaannacnnntgcncncaacagcttcattggncccnaatnntccaaccnctgatcggnnnacnntcaaaaggctanngganccgtnncgtntanaantngnaaacnangcccaccccc

SEQ ID NO: 4944 - DNA, 1201 bp, Homo sapiens
  misc_feature (1)...(1201): n = A,T,C or G
ncccccacnncnncnnacacnnanacnacncacacanannnccnancnnnnnncncancnaaccnanaatananaccncncacnccnnanancanacannnacnnncnccanacnaanaaaaaaanctnncannnnnananacaaaccnnganaganaggancncttttncnaanaaaanacncgggnannnnncnggaaangnannacacgagagngnanactngtnaanagccccttttgcnaaaaacnccttngggcaaaancncccgcctcannaccananagnncatngnncncnntacnacgccnaancatccnaatgccntcagctannnngngggangnggggaaccccacaacanaacnananannacnccnacctacncnacnacannnaacnngaccatcactccaaccaggacaacnncaacaaactacnnananccgacnaanatctnancacanccctctancaaccannacaccaacaccaacncctncatcnacancccacaaaaggcacnacaccncanaccccatcaccatcacanccaaaaaaaatnnnngctccnaccacnccacaacnnncagtnacatcancggaaaccangattacannanngannncaaacanccatcgcncncncntacaacagcgnnaannacatccaaaccnngaanccaaaancgacaacatnttatncccaacaanagggcaacangaacaaccccncganangnganaanatanacngaaaaangcnatantccnatcacccaannncanaaacacntnctnnncccnggnacannnccataaaacacatagccctnaaaaacaacnncnnaaaacccagacnnnanccncaaaaccaaaanatctcgcnanaaactctaananatcnaaccaannanactaanacncntcanaaaanagcctcnacggaggaaaaaaanaacacctannacaaaacancaccacnntggannacaaaaaanctcncncaaggcnctctacanttaaaaaaccccnnnactncacacncncccacanacacanacncgcaacctcanntntcaaantaaaatcnacacanacnanccactanccnnncaanacnantnggangcaaancccnaaacccnntntntcnannnngncccccnaaccctcncanaaatnccaanacaancancc

SEQ ID NO: 4945 - DNA, 769 bp, Homo sapiens
  misc_feature (1)...(769): n = A,T,C or G
cnttttnttttcttttcaacangctcttgntctttttgcaggatcccatcgattcgaattcggcacgagcccagatgggggtgtttttcaggtctctcacaaatgagacaagcgaaacaattgtctccttttattctctttggtgcattggtgctggggaaacatgaactagcggcagtgtaactgcagaacatagacccagttctaccaggccaggccagcactgggaaccgccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgcccgcctgagccctcagagctcccctgtgcttttctggatggggactggcggggtcacctagcctcaccgtggagccaccgtgcaatgcccatctctgagaggcccacgcagtattcctcgtgccctgtgttagtgcnttctgtataagggacagacagaactgggttttttttcctctgcctggttttagagttaaatgtaactaacttttatttttcccctttatgaaagatagaaaattatttttatggtagttttccaganctttatacaaaaattttttgttaaaaatgttctctgggaaaagttaactncnacgaatgtaaaatattgccttctaattaaaataaccannn

SEQ ID NO: 4946 - DNA, 769 bp, Homo sapiens; identical to SEQ ID NO: 4945
  misc_feature (1)...(769): n = A,T,C or G

SEQ ID NO: 4947 - DNA, 738 bp, Homo sapiens
  misc_feature (1)...(738): n = A,T,C or G
ntttcaaatcgcttggctacttgttctttctgcaggatcccatgcgattcgctactgagcctggcttgcaactggggtgagctccaccttgaacgtcgatcctcctgcctggtggagccatcccagctgatgccacatgaagcagacacaagctgtccctactaagctctgctcaagttggatattcatgagtgaaataaatgactgttactaagtnaaaaananaaaaaaaaaactcgagcctctagaactatagtgagtcgtattacgtagatccagacatgataagatacattgatgagtttggacaaaccacaactagaatgcagtgaaaaaaatgctttatttgtgaaatttgngatgctattgctttatttgtaaccattataagctgcaataaacaagttaacaacaacaattgcattcattttatgtttcangttcagggggaggtgtgggaggttttttaattcgcggccgcngcgccaatgcattgggcccggtacccagcttttgttccctttagtgagggttaattgcgcgcttggcgtaatcatggtcatagctgtttcctgtgtgaaattggtatccgctcacaattncacacaacatacganccgggagcataaagtgtaaagcctggggtgcctaatgagtgagctaactcacattaattgcgttgcgcttactgnccgcttttcantcgggaaacctgtngtgccanctgcattaatgaan

SEQ ID NO: 4948 - DNA, 795 bp, Homo sapiens
  misc_feature (1)...(795): n = A,T,C or G
gncnncncttttgnaaanccccttttnnnnaagnnccttncncctttgcnaancgcttgggcaactcgcantctctcnanacagcaaggnctgtggcgaatncggcacgnagccgccnnntctncanncnntgtcaggnnnnagnctgangctancnnctncnnantgcgnncnnngaancccannngacagcnnccnngcangcacgctnccncacngnacacaanctttaactaactgcccnactnccaatgacgaaaacatntnggantgactgccgaaantgcctttccngatntaaccactagacnatccatctgtatcacnnngttnagccatctttacngatntaagntccactgaacggctgagaaacttgnanaacacantgnacncgnnnaagnctngaacacaactggnccaaggaaaactaanagtgcnatantgnaacccanantggcatccacanaaaggcnctttaaacntgcangctcatcgtcaaagaatnatccanatncctggacactggcnggacacnnncatgtcnatcnatgaacaacctanaggcnttgcctangaancgctgcctaccactnnnnatgatangccgaacannaatatctantnccntcnnnctatannnntcnaagnantaaagnaccnnnntatncaagnnaannnannaanctagcacatgnnctcanangaacancaaattnatacnnganaatngtnccttnnaaaacntcnngggtanacttncncanntnnccancccctaaaanntcccnnnnc

SEQ ID NO: 4949 - DNA, 784 bp, Homo sapiens
  misc_feature (1)...(784): n = A,T,C or G
ttnntttttttggttaccctttgctctnggnctttttgcaggatccctcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagttttattacattaaacttgttaacctaaaataccatcaaaaaaaaaaantncnnannnnccncccaccnancntncnaaaaaaancctcgancctttaaaaacnnntngnngaggccntatttacgttanattccagacnttgaatanggatnccatttgnattgaaantttngggccaaacccccaaccttngaattgccattngaaaaaaaaatgccttttattttgnnt

SEQ ID NO: 4950 - DNA, 737 bp, Homo sapiens
  misc_feature (1)...(737): n = A,T,C or G
gttcttttgcaggatccctcgattcgaattcggcacgaggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcntaagggtagatcagaaatgacaaatgaattcaaaacctagcaggtgcattgtaaatgtgtgcccagttatgttttggaaatggcagttccttggggtcatgtntctactggccaaatttgcaatagtgttctatngnatgtaatttctaaaatttattaggattatccncgttggccaagtaaactgtctgccaatagaattctgggaattgtgagaaattgtatcattgaagttcagntnngatgngtggcttaaaaaatttatcnnggacccccanacanggaaacnanaantatttngntcctgcanggttcattgccacgggcanngaaggtatttcccagaaaaatacctcnnn

SEQ ID NO: 4951 - DNA, 785 bp, Homo sapiens
  misc_feature (1)...(785): n = A,T,C or G
ttgnanccntttgaaaccctttttananttctancatacaagctacttgtnctttttgcaggatcccatcgattcgaattcggcacgagggcnactntgnagaattcgtacngatgangactgcanaatgaagacctactttcaacttncttttgnccccctctagnagaatcaaatngaatcttttacttacctctgtgcaaaanaaagaaaaatgaaanangtncatntattcattctgttnctatatagcaaaactgaatgtcaaaagtncnttctgtccacacacacaaaatctgcatgtattggttggtggtcctgtcccctanagatcaagctncacatcagttttacnatataaatacttgctctaccttaatgatgaggactccttaaagncncatttgctantgatnaatacactgctngggctggccagttttnnatgcntgcagcttgacnantgagcacactcaggcctttgtnttaaaaatgaaaaatgaaaaaacnaattcaaaacctattcaaatggnttctagncaatttgtttagtataaattgncatagctggtttgcttgaaaacaaacacatttaaaatnggtttacctcaggatgacgtgcagaaaaatgggtgaaggataaaccggtgagacgtggncccactggtaggatggacctttgagcttctggtgctccgnccatggngacnatgacacaccctggnggcatgcccctgtatgtgngttaacgntgtctgcattgtctaaantgaacangtgttagc

SEQ ID NO: 4952 - DNA, 1523 bp, Homo sapiens
  misc_feature (1)...(1523): n = A,T,C or G
gggggggngnngcgnngntngggggggggggttnttcnnnnnnnntggngacacccctttttttngggggganaaaaacccnnggngaggngcgngngggggctngnggggannnctggnnngngnggggngggggggcnggnntggagnngngnggngncncgngngngggcgnngnncgnggngggnggggngggggtnntttttttttngggnncngngagggggggancnaggcggnnggggggggggggggggntggngttgcnnggggnggaggggggngggaggnngaaggggaggnggcggggannggcgggcagnggaggggggncgngggngggtggcgnggnggnggcgggngngnggngccgnnttnngggnngcgcggcgnctngggcgccggcggggangngcgcggncgtgngagggnagacgggagncgnggcanngagctgnngtcnggngcngggcggggcgnagngagnaggctcnatnggggggnggcggggngtgnggnggggncnncgaggngggggannaggcgtngggcnggntcgnnggngcgggggcgancggggagnntgnggngggggccaggngngggnggggggncgggnggggngnatcgcnnngcgntgacggngtgnncgggnccggcngggcgcgcgngancncgggaggaacgncgcangggggncagtggtngngngccgangtcngtgtngngcgagnggngngagagggagngnngntgggtggggncgaggggatggccgagngtcngnnggggggaggnggnggngnngnnngagggcgntngnntggctnngggggcccaggngcnggcnnngcgnggnaggggngnnngggnaggcgggcntgggntggccaganagngnnctgggggggntagagngcggngnnggggnnnntgnngagacgggcngagcgggcgggnggcgggcgngngngngcgtgnnagagcgngcgggngcgngtgngnccnggcggncngnngcagaggngggacacagcnncggagngnggtgnatgnngagangagngngnnnngtggcgnacggttagcgggcngcgnggagagngaggtgncgntgggggagcnntcgcgngctagagaggcngcggcgnngngataggnggggnngagcntgngnngganncggatctagggagcgcgagtgggnggnggtngacgngagggggnngtgntnggagagngggngagccgngngcngntgtagagagncagnggcgtgccgngtgggcanagggcgngtgcnncngtaganatggntgnngcnctgcggcgngcgaggcnntaggnngngtgnngngggangagcgngtgtgggcgngcgcgnnggggggcggcngagtgacgntnngcgcgatngnnnggccnccgnngcggncgcagangngangggngnngcnnncgcgnggaganngnnaggnacagggcgagggangcgangngntgtgtgnnaggngcggnnggt

SEQ ID NO: 4953 - DNA, 758 bp, Homo sapiens
  misc_feature (1)...(758): n = A,T,C or G
gacttcnctttcnaanannctnggaagctnantnncctaaananaaggtcntgggcgagagttctggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattgggaaacttttattccagttaccaataacacattcctcatttnctccagagacctcaccagaaacacctttaatattcatatttctagcagccttctgttcataacaatatatgcatcctgttaagatgataggagatttctcttgcacctctcctctttgngagcctgcangggacattcccttttaatgtccatatttctaccagcagttctcttnaaagcaagtctaaggtntttcctaacattacacctnaaaattcttgcanntnttnnccaagcacagtgccttacatctggtaattcctaacactttganaaggccnaacatggaacaggaatgcttgagctcaangagttcaagaccagcncgggcaanattatggaaccctnccttttcnaaaaattncnt

SEQ ID NO: 4954 - DNA, 781 bp, Homo sapiens
  misc_feature (1)...(781): n = A,T,C or G
tgagncnttnnanccttttgaaatttttanacagctacttgttctttttgcaggatcccatcgattcgaattcggcacgaggttgctcttccatgcgttggtcagggggccctgaaaacactggtaatattaagagtctttctcagggtaacttaatgttttcttaatgaacaatgtttccagctacaaattctttcaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggatangaaacaagtatttctcttctggtatacatgtaatgtattctgtaaaaaagtattcatattggcaattttagttaggcataatattgtggttgtaatttttaaaacttagtgttttgtctgattaaagcangcactgatcagggtatctcctaagaggtaattcacttcttattcctttccaataattattacattctaaattttcatctatgagaaataacaaacaagaagggaatagaattaaattggggtataatctaatcttcattggttaaatggtttgccttctcccattgaagccattttttatagcctcanaaagaggaaataatgccttcacccattttctacctggtgacttgaaaaatggaccttttaagttaggaagaagtt

SEQ ID NO: 4955 - DNA, 939 bp, Homo sapiens
  misc_feature (1)...(939): n = A,T,C or G
gnnnttctaatttcctaaatggctgggctacttgttctttttgcaggtatcccatcgattcgaattcggcacgagtgaagaggaaaaagttcaaaaaataaattacattttataaataaggcaaggaactggacattacctcacatctgcaattccaaccctctgggaggccaatgcatgtcattcnttccnatanntncnactcnagacacatgatgtgattcacagaacnaganaangnntccacctactgtcctgnttnangnngggatgctncataaagaggatnacnnttaanccactaacagttatgcctntnatcttgaatctgttcctactagttttcgtntncctgggcntgttactttatgtttccttncntcannttacctttaatatganaatantnatnattntttnaccatggtcccttacttnanngatanttttntnatnnntgcatngnnatannancntnnngtnctttcnncantntaaattcttaannntnntcnttattcnntnttcntntntntttnntnattnnnnnntntntacncttannttccncnacatcanccaatttttntnntnnnttnttncannanaattnnntnttttnatanattttnntntacttntgnnanatngggntnattttncntnncnaantggttnnnnnnntttttnncncnnnannnaacntcntttnatcnnttctnnnatnnncnattnattantctntnnctnttnntatcnacncaattncnntatnntnatctntatannttnnnaatnnntnanantacntntannntnttctntnntnttntanaatccnnaatntatcttntnttnnnnntctaaaanagctnttnccntttnnaatcncttntntntnnattntnttttantctntacnanacttttnttacttcn

SEQ ID NO: 4956 - DNA, 780 bp, Homo sapiens
  misc_feature (1)...(780): n = A,T,C or G
ttgancctttatacagctnttgatttganacctttanacagctacttgttctttttgcaggacccatcgattcgaattcggcacgagggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtcctttcacgagacctgaattttagaattgcccagtgctgccagagtg

SEQ ID NO: 4957 - DNA, 1210 bp, Homo sapiens
  misc_feature (1)...(1210): n = A,T,C or G
gtnnnaacngttaacncntctgtctttgaggtccatcgttcnatcggacnagtatgnatgcatncctcccctgtgcgatgagnntgncangannnacagcacatgggctntaggacnttnangtgcnnaanctnncngantgnnncngcacgncnacgngctncttgcccgcctaangtgaatatcgtncncgacatgnagtgcatcangagtganngagcccctngcntgaatgtatntcgtcntcaatacnntntatcgccnacatnccttnancntngctaccacttcagcatgatcccactgctcgaatttgccattcngtaattccttaacnaggngcntgnaanngcggaaacnttngtccaagtnganacccctagctctttanaagcgnttntnnntggggaaaantnccanncctnggngacaagantnggatttttaacccaattgggggaaacccgccttgggcncactttgngggtttnnccccaaaattttcccncccttgggantaaaaanncntnttttcaaggngagcgggccttcancanattnccngttaaaggngntttctgattcaaagnccntgnccggtggaantcnangnggnanagngnaaaaaattccnttngggnactgcanaaattncnncgttcggattgggngnnntntnccannanggcccctgtntcccatangggngnaaaactccgggccantttttttttaaanaaaacctngggaaantcccntttnttaattaancaccctggggacgtccanattggggggngacatttgcncnatggcnttagcctatanttcgtaccncngaaaaatcgggagantnccctttganaaanttntnccagaaacntngccncanaacctttcggncnntggngtttggtcaattgaaaatccaaaaattanntggcccctgnnagacnggnnntcaaataggccgcttnntggtacttcncctaaacaatcnttngntagngcattngcgctcaatggnaanttcancctnccngngnacntngggaannggattttaaacccggaaaaantttnaaccnnaacnactgggctcatnngctacttggnttccattaaacccgcnnntgattancgggncttancagnactttgcacggcnatgcanctagtgacccggnnnggttncaanncttcntntgcc

SEQ ID NO: 4958 - DNA, 837 bp, Homo sapiens
  misc_feature (1)...(837): n = A,T,C or G
ttttttttacttaacatntnngcctactcggnnctttttgcagggatcccatcgcnttccgaanntcngngccgagggtgtggntccaagttntncatgantagcaacnaganggtgtnganatnantgtgtaaggctgngaattcttgctgnaggaatcgnagaanacctgntgctgcaaaatcntacatgttccacatgganagggaagnctaancgctattcanaacanttcnnttttgtatttaattaancnattgcagctatctgggattttcgggncagaatattaanttcctggntgattctncatattccaatgnatnaaatncanaaccattgngnctttaagatngtgtcaatnttcacctaacaactngtgccnnaagcacctgcattggtaatnatatttcncttaaagggcaaattctgncantntcctgntaactcaaaagtgcattnttccncttcaaaaatgttgntctcagtnatcncacatnctgcaganatntatttatatctatacntatanctnnntgaaatacnnttactcacnaaatntattnctgatnaacattcccatgttaaatctnangccccaaacctttctaaattntggcccctnannccnttaatattntaaaaaaatctaaaattctgnnntttcaaatttgnnctntaagcnttnttaanaaatnttcncnaccnttgcctttccaataccctnccccttggnttaacnaaatttnctttnaatanccntcaccttcananactggattctctttcaaattnnntctngcntcgaatcattantaacttttgggnctctcncct

SEQ ID NO: 4959 - DNA, 1302 bp, Homo sapiens; identical to SEQ ID NO: 4925
  misc_feature (1)...(1302): n = A,T,C or G

SEQ ID NO: 4960 - DNA, 769 bp, Homo sapiens
  misc_feature (1)...(769): n = A,T,C or G
aanaacgtaattnaacgctagcgctctngnngatccngnagntctntcnttcttccaatgccngaananctgcnntggnatgnngctacatgnatctaggtgttgangctttacncgcnagttgncngatgacgcntggcanangnccaggntntnnntanatccnaacancatantgaggnatnggatgcctacnngcagagncgacagaactcacgctntaaaannaggcgccacacacgggacgantacgtnagaaanaatncnntgtgngtgtnnttcctactcncttactcacagcncatcagaaggaagnngacnacnagctngaagcnggcttnataccnnatatcgncngctacancctgngncaccactgccatngcgatgctnnactncanctaattntaccatnnangatgcntcatgnacctgnnctagcnccggcanncttntggnggcccctatnntagagaacggcttnnctccacactgtaatggtagngattgtggatnttcctctatcatggaaggganttgaaacngntncnctggagggtnnggntgtngactgcacttgnagcattcgnattcatgntganctcggagattnactctggngttccatcaactntgantncaaacangatgatcnnngattaggncgntttccaatgtttgngccaaatttgttaanannaacnacnggattncaanttaanttggnnaanccntnttaaccnttcgggctcntgctcctnncntngcc

SEQ ID NO: 4961 - DNA, 880 bp, Homo sapiens
  misc_feature (1)...(880): n = A,T,C or G
tnctttnnttactttcgctcccgttctttttgcngatcccncgattcgaattcggcacgagagagggtggggtctggccacataggtacctctgtggctctggtctggggttagacactgttagggactagcatttattggacttgtaaagacagcacctcagaattagtaactacttgcattttagggtctgttttatgaagccaacaagtgaatgtaaaataggctctgcatcttttctgagagccctgtcactgggcagtgagcatttccaaaattgcagctctgtcagaatgaaccatgaatacttaagaaagggaaagtaggaacagggagcagagcaaagcataacttgctgtgttccagggatttaaaaataaattactgtcaagagcaatataagggtcatgggtttgatcangaacttttttgtaaatgaaaaagttcacaattttggnaaaaacagtgctagatgtgttatggaaattgttatcacanaattcttccncctgaaacttcaagttntatnaagacaaccaantatatttgcctgnngaaattcttaaatttcttgnnccttatngggaaaggtnaacccaanacnntcangnaancccattcccntttttttggcntttggaaacttgncnacccggttnggncancccccaatttttcntaaaaatttaatggtaaaaccttttnanacccantatcantnnnnnccattancnaccccnctncatntaccccngccccntctncttnaatanaaacttctcngntgcccctttttnnaaanaantcttttannnncgaacccccntctttttcccgcntnnatattnccncatcccttttgnanttcacntactccnnt

SEQ ID NO: 4962 - DNA, 880 bp, Homo sapiens; identical to SEQ ID NO: 4961
  misc_feature (1)...(880): n = A,T,C or G

SEQ ID NO: 4963 - DNA, 778 bp, Homo sapiens
  misc_feature (1)...(778): n = A,T,C or G
tctttttttggaacccnttntngctctttttgcggacccatcgattcgctctggagtagctgggattacaggcatgcaccaccatgcctggctaattttgtatttctagtagagacagggtttcgccatgttggccaggctggtctcaaactcttgacctcaggtgattcacccacctcagcttcccaaagtgttgggattataggcgcgagccaccatggctcagcctcatgttcgtttttaaaacttaggatggtggctcttttacattgattggtaggaactcttcatattacgaggcagttagctagttgtctgtgaaataaaatactaatgattgaactttctaggaagtacctattctgctaatagtgtaaatatacacttatccagggtcagaaatactcaagtttacccacttaaaagatctagaaaatacatgaacttgggcttacttgccagttaaaattgnttatctcagaattgtaccatcaccttaattaaagtagatatgctaggattatcctgataactaattaacatagcctttcccccttagtgttcttcacctgaatgtagtanttgnactcttcaagtctagcanaggccaataaaaagttcagagttncanaaacatcaaancctnntcnancncnnnnatannnncctcactcacatcnncncatccccacntacaaacncacnnnnncnncccnntnnctnccccnttacnnctacctcnccnttccntcnnaantccctccncacgcncnncnnt

SEQ ID NO: 4964 - DNA, 778 bp, Homo sapiens; identical to SEQ ID NO: 4963
  misc_feature (1)...(778): n = A,T,C or G

SEQ ID NO: 4965 - DNA, 827 bp, Homo sapiens
  misc_feature (1)...(827): n = A,T,C or G
ttagntnaaccctttgaaacccctttgaantntttaaaccctttcnaccgctacttgntcttgatccnagnncncctcaattccgcctttgttccctctttccatgccgtttnttccnggggcccngganaacactggtnatattaacagtctttctnagggtaacttaatgttttcttaatgaacanatgttccagctaccaaattcttatcaanaaatcggcttcctttntgaaaagtactctcatagaagaaatttagcaatttctcgtgactgactcaanctattttaagtatncanaaaagattttgatccccattgagttaatgctctgccttgaaaattanttttctgatccttgntagtgataacattttttttctactgaaggtcagaggatnggaaacaagtattcctctnctggtatacatgtaatgtattctgtaaaaaagtattcatatnggcaattttagttangcataatattgtggttgtaatttttnaaactttagtggttttgncctgattaaagccancgcttgatcagggtatctcctaaagagggnnattccaccttnntattcctttccaatgaattatnacattctaaattttcatctntggagaaannnacaaccaagnanggggaatnggaattaaaattgggggtataaatcnanncntccattgnttnaaattggntgcccttcncaccanttgaagcccatttttttatagcctcagaaaggagggaaataaatgccncccacctttttnttcctggtagacttngaaaaattnaccntttaagttangaacaaagtct

SEQ ID NO: 4966 - DNA, 785 bp, Homo sapiens
  misc_feature (1)...(785): n = A,T,C or G
tttgaaccctttnacancttttgatttttaancctttncacngcncnngngcnggancnnccccnngaattcggcacgagggtgtgcggctgtaattttagctattcgggaggctgaggcaggagaatcacttgaacccaggagacgaacgttgcagtgacccgagatcgtaccactgcactccatcctgagtgacagagcgaaactccatcttgggggaggaaaaaaaagaaagtaatagggangnaaatcagaanttgtgtgggantccccctatntctggctcttgntannatactnnacctgtcaggcnatnctgagagcgaangctnctgcntagggctagtttccattcagantggtttttgataggcatgaactagtctaactcaaagcatacttctgtgtaagctagcatagctcctntacttggcttcatancnttggacattaatcgagaaaagtgaaaaaggagggtttggncctgccttgaatagcatttgattnttaatcctacattntatcagagccccagcntttnaaatgtttaatagccntatgtgctgttttgccacgcttacnaagttngtacttctgtgaatgaaaaagtgtgactggactnacataaactggnattgactnncagtcatcagtntatttccatnttcaaggnaaaacccaangactgggttntcctctnttttcttttgaanatganngcnnctaaaaatcaantaattggggctggggtgtggaagcccaccttgtgaaantcttatgctttn

SEQ ID NO: 4967 - DNA, 975 bp, Homo sapiens
  misc_feature (1)...(975): n = A,T,C or G
annnnanncnantnnntnnnatntnannncnncntaantnntnnnatcnnnanncnnanaanatntnnactnnaaanaattnctaatgattaanggggggtctaatgcttggaaactcccncgantaanaggttngtcggcngctctggctgcccggcggttnagcagcatggnctctncaggggcacagtanngcgcctcccganttaccggagcgnaactgccaggtaccgcnaagtcnnctctggnatcagcgctaccaaggcgcagncgantctgccaagctaccttaggancggggactnatcctacttccgtgccctactagagccggagntncngnccgaggaccgnatcnttgtnctangntgcnngaacanngcnctgatctactaatctgttccntangacgctnccntaatgnnaccagtgcngactactcatcnatacnnggnagcttgatangcnngctnacnatgcccatgtgcccnnatcctcnctnngaaaacnnngaatgtgcgcgaangctgngacntttcnccaaagctttgtttttgaantnggttnntcgaaaaaanngncncnacttgggaatncccctnaattngcatggggggaaactaaagnttccccttggnaaccccatnntanccctttntaaaaagggtatttaaccccaactttgggggcaaccccaaaantnttttgtaaacntntaatnttcggaagcccctgggaannantttgngnaancctntagnnaaggggcccnggnanttcttnttcnttnnaacangaannttttttanngccnngaccnncctcgannnttttaaaggggcccnanaanccnttnttggcccnaaaacccttttagnggttnagganccttgaggaatgccccccttttggnaatgnggatttccacttnccnatgngtaacccnancanaaaanggnggaaaagctaaaancc

SEQ ID NO: 4968 - DNA, 1150 bp, Homo sapiens
  misc_feature (1)...(1150): n = A,T,C or G
gncacgntnttactccttgggnaatnagttngnttnangccctttctctaaanagaaatgngngntggcgaanttcggcacgagtnngaagcatncacatatccttagaatagtntnacttnggctatnaacccctngccggctgnggctccccantgtngtnantctgnnatgtgctatacccaacctagagcangggcgccatgcctggctaatnannngtnattacttttntcancagatggggtcttcactntgntgnccangcttgngtctagaactcctgggctncaanttgatactcctgcctgagcctcccaaagtgcntgggattatagacatgagcaaattgtacttgggctcaaatttcttgnttnaaattgggcttttttgtcagaagnaatgngcncncctttgaattatnattttgatcttgttctcattgtattacttngnacccctattcnnacnatangantttctatntttattcaatgaaagcngccctggggaatttatttgnaccttngtanccacntncngnggcctntgnggnnntctaaatatcnntngtccgctctacntnnaatntcggggggcnccttatactcnggtncacnnnatngnaaaaatnggttgtcctntaactttcttnncaaaatntgcggcagatnntnnttgnggnntantttnnanagcnctnttngtnanntnncnttttggngncaantttatncactntgngaaanancccctcnttatcnntataaccaatttcggnaanatnngtcanatattntacattatcctctaattnntnccccaatangntnanttactctncaaatnnnnctantattcgngnntctatncnanaattntctanananttctntnccantttctgngantntttctgnaannnttcatncgtgcggantannctatgnggacntaaatntttntancccccggannttnttncntaaaaaangataangnctttttccacanactccaacaaantcctngtggannacttaaantnnntcatcnccctcnggnaacatgtctnctntcttnanagtacncatnttggatcnatntanaaaggnaaatnntgatnnggngctctntctacttatcancc

SEQ ID NO: 4969 - DNA, 772 bp, Homo sapiens
  misc_feature (1)...(772): n = A,T,C or G
gnntttctaangcnngctntcttctgcngctccnncnatccgtgnntacacancacgncgangnntntctgactnttnnnctatgtaatangcaggngtagttgnntntntgctgccatgnatgnatnnacatnncatgtgcagtgtctnacgtaatacnctccnatnaanctngttgnncntactnntcnncaacntggatatgncantttgnncagnacnantgntgcanattggaanatgatggcctnactcttacnatgtgattgcctatatgncctctnnaccttgaatacntntgntatncnanncanagtnctaaaggatgncnatnatagcagcnctctttnnaaataaggaaacntccttgaataatgtaaaagcctcatatacaataatgaataataaagaataatgtgaaggcttcattcaaggttgnngtttgccagatcattgcaacaaaatgacagagcanccaacgtatttangatagtggccaaagtattgtaatgatggcttatggagtgtcagctggataaagagtgaaaatgactaaaaactaatggattgttcagtcgaatagcanatggtcaatggtcatggccagtataatagggggacccaaatanaaattggaagacccagtcanaagtgggganttgatcaattccanccaaaagtgggaatgggcaggggaatcggtaggccccanggttccaaaaatgttaccagnggncaattttgttggccccatggtggggaatccaanggc

SEQ ID NO: 4970 - DNA, 710 bp, Homo sapiens
  misc_feature (1)...(710): n = A,T,C or G
ttcnaatagctnggctcttgttctttttgcaggatccctcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttgagttggtggattaactgagattaacagagctggaggaaatgtaaaaagaaaggcaggattgttcattttgtcttttgtttgttttggggaacagggtcaaaattttcattctgcataaggtaggtttagtctttttcaaaacattctagtaggcaagtctgtagctgaatcttggaagaaaggcaaccatagtaatatttttgagttcctactgtttattttttcaataaaaactcaggttctcaggttagcagatcatggtcttaggaaggtagctgtagaacccaaaatataaattcctaan

SEQ ID NO: 4971 - DNA, 710 bp, Homo sapiens; identical to SEQ ID NO: 4970
  misc_feature (1)...(710): n = A,T,C or G

SEQ ID NO: 4972 - DNA, 710 bp, Homo sapiens; identical to SEQ ID NO: 4970
  misc_feature (1)...(710): n = A,T,C or G

SEQ ID NO: 4973 - DNA, 755 bp, Homo sapiens
  misc_feature (1)...(755): n = A,T,C or G
tcttttcnaatcnnntggcncttgttctttntgcaggatccctcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcnagatttcagagttttccaangtgtaaacaactaaattttgtgatccaaatgataagggccatctaatangctggggaatgtgggatctgncntggctganntgntggattaactgagattaacanagctggangaaatgtaaaaagaaaggcacgattgntcatttngtcttttgtttgttctgnggaaccagggtcnaaatttccattctgcatnangtncgntnagtccntttcaaaacattcttacttangcaagtcctgtcnctgaatcttngaaagaaaggcaccntnnctaatatttttgagttccctactgnttaatcttccccaattaaaacctcacgttctcnaggttncccacaacatggcccttacggaangctngcttgtcncaacccaaaactctcacattnccttaaacnttttnccccatttggggcn

SEQ ID NO: 4974 - DNA, 755 bp, Homo sapiens; identical to SEQ ID NO: 4973
  misc_feature (1)...(755): n = A,T,C or G

SEQ ID NO: 4975 - DNA, 755 bp, Homo sapiens; identical to SEQ ID NO: 4973
  misc_feature (1)...(755): n = A,T,C or G

SEQ ID NO: 4976 - DNA, 761 bp, Homo sapiens
  misc_feature (1)...(761): n = A,T,C or G
cntttctttttnnaaccntttgcctactcgctcnttttgcaggntcccatcgattcgctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacngagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagtttctctggcggcgctggtcctgtctctcattctgccgaggagcagccngtacatnaagtggatcgtctctgcngggcttgcccaggtcancgagttttcctttgtcctgnggagccnggcgcgaagagcnggcntcatcctctcnggaggtgtaccctncnttatacttgantgtgaccacgctnancctcttgctcgccccngtgctgtnnaaaagctncnaatcccgaagtgtgtgcccngacccgaagaanccngtccancctttgatggcttcnnagatgattggacccntggaaangggaacctcttcnnggngaactnaancgcnttaaaatngccananaancngctncctttctcggnaaccnncnccccncn

SEQ ID NO: 4977 - DNA, 761 bp, Homo sapiens; identical to SEQ ID NO: 4976
  misc_feature (1)...(761): n = A,T,C or G

SEQ ID NO: 4978 - DNA, 761 bp, Homo sapiens; identical to SEQ ID NO: 4976
  misc_feature (1)...(761): n = A,T,C or G

SEQ ID NO: 4979 - DNA, 850 bp, Homo sapiens
  misc_feature (1)...(850): n = A,T,C or G
ntcnttttgtttttcaancnattngcctacttgttcnttttgcaggatcccatcgattcgctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagtttctcctggcggcgctggtcctgtctctcattctgccgaggagcagccagtacatcaagnggatcgtctctgccggggcttgcccaggtcagcgagtnttncctttgccctggggagcccgggcgccaantagcgggcgtcatctctcnggaaggtgtaccctccntatacctgagnngtgacccncgcctnaagcccttcttgcctcgcccccccgtncctttcgnaananncttnncnatccnccaagggttgtnnttgccccccaanaaccccggnancanaanccgggtncccaancccnttcttnaannggcctttcgggcnanattcnaantggggcccccctcngnnaaangggnnaaannccttcttntnnggnggaaatattgaaaccnccttnaaaanatgggncccnnccnacctcgctccctttttntggggcaaaacctnnngccacccntncg

SEQ ID NO: 4980 - DNA, 1523 bp, Homo sapiens; identical to SEQ ID NO: 4952
  misc_feature (1)...(1523): n = A,T,C or G

SEQ ID NO: 4981 - DNA, 757 bp, Homo sapiens
  misc_feature (1)...(757): n = A,T,C or G
tnttctcnnctgnaaccctttttctaaagncccttttgcaggatcccatcgattcgggagaactgctcactccttttccctccccatacaaactcaaagtcctttgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattggnttcttagccatctgtcaggaaatgtaaactttggttttattttttggcttatnccaaaggggtaaanccngaanatagaaaatggataattttctnattnaatagcngaancctttttcaatctccaaatatataanggngccncntctnttnaaaagctctaagcctaaagtcaagagctaggant

SEQ ID NO: 4982 - DNA, 728 bp, Homo sapiens
  misc_feature (1)...(728): n = A,T,C or G
gaggnnttgaagccnttttatagatacaggctacttgttctttttgcaggatcccatcgattcgctctcccgggcttagaaggcccggctactgacgcgcagtgccagaccttacccctcacggnccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcanggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaaagcacanacnacaagaaaccangggaaagaaaaattaagaggcatgctaaaaataattgaggttttcatgattcagcacctgcttttgnttctgtgagatgagctaaatttgctttcataccccagataagagcttaaaacccacctaatgctcttatggcacaactggggtatagaatttaagttctctttatacttcaattctagcccaanttgggttttgattaatataagtngtttaaaccttntcttnataacttgctctgaaatggggaacaaaant

SEQ ID NO: 4983 - DNA, 747 bp, Homo sapiens
  misc_feature (1)...(747): n = A,T,C or G
ggnnnnnnnnacgctatgctggctcttgttctttttgcaggatccctcgattcgaattcggcacgagctaggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcangatgcccatggattagactcatgtagtagcttaaagagtcattaggcgatagganggagaaaccaagaagttagcagaatctggatataattcantgtccgtaaatcccatgaagagaagctcatcagaattaaggcaatggaatttgtgcccaaaaaaaaaaaaaaaaaaaactcggn

SEQ ID NO: 4984 - DNA, 1195 bp, Homo sapiens
  misc_feature (1)...(1195): n = A,T,C or G
gggnnnnnnnnnnnannannnannnnngnnngnnnnannnnnnnncnnnnanannancnnnncnannnnaggnngaggagnangannnnnancnntttnancccccntttttnnctaaaaaaagnacccttggggttaaaancnccccnttgnnccccnnaacacgagaaaaaaggggggcnggggggnggnnnnagnngnannnccnnnnnncnncnngnncacnaggncnggagcnaagaagnnaacnttttntancangnnaanccnatnncncnnanagcanccncggggggaaancnggaagaccncncnnngggnnnaannanannancnancannngngagcaaacannganannnannnggcnnaagcnaacncnnannnnanncccagncacgnnncncnngnncnnnannnannaccnacancncnnnngacnnaagaannacgncaanaaacgnannnacncnancncagnacnnagcnnnanaacacccanncanaaccaaaaanannncnatngcnnnnnngnnannnccnnnncaannnnncnnnnnccgcnnnnanancnnncanncagncacanncgcacancnancnccannagananngcccaancnnaannncannaggncannnacntnaaggcanacanacngnncagcacncnnanacgangccnnagnganccacacanncgnannncnnnnnnnacgnaaanancangacgngcnnncangcgnacanaagananaacnnacganccnannnaaacancagcnancannannannnanngcnnncnnnngannncnngnncgacanacananannanngnngancccnnagacnanngacnaaancannacgangacangcgngcancnactcaannannagnacncccnanaacnacncnnaccnncgcngacacnaccaaanaannaacancacnannaacnganaanacnaccnccgcnnngnccganccnagcncncnncagncnnaaccnnannaccannnncannncncccncgagccgnccngacanacacncagaaccnnnnnacaacaanacncncatcanannngncnnccacnanntncncacgacnancgcanacnncgacnnancnnngnantnncagcgacagcgnanacncntacnngnnaacnncnnnncgnccg

SEQ ID NO: 4985 - DNA, 735 bp, Homo sapiens
  misc_feature (1)...(735): n = A,T,C or G
gcaatgtgctctngtctttttgcaggatccctcgattcgaattcggcacgaggccttttgtggggtctcatacataactcagtttccacaaagctgtgccccagctcagccctatggntagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcaggatccaggaaagaaataattgataagctggacttcattaaaacgaaaacttctgctctgtgaaagatgctgccaaaaaatgaaaagacaagccacagactgggagaaaatatttttgatggaaatatctgagaagagaggcttgttatccaaaatatacaaagaatttctaaaactcaataatttgaaaataaacaacccaatttaaaaagtgggccaaagatcttaaatgacgccttaccaaaggaagatcccnggatggcaaaataagcntatgaaaagatgcttccnggctgggcacngtggctnacgcccgtaatnccancctttnggatgccaaggcaggcagatcn

SEQ ID NO: 4986 - DNA, 1497 bp, Homo sapiens
  misc_feature (1)...(1497): n = A,T,C or G
cnttcnnnttcntgaacctttttttccnattccccnntnatctcncgtaatncccnncanganttncnncngcatcccnacttantntcntntgngngcncagaagntncgngacnnttttttngccccccanactgcgngtttntannangnnancgccnngtcngtnntnncnttgncnnnnnatatccanncctnnctnnntnccctancgcacantntcncaatantnnaacgnncnantnaccctnccnatccacntcanagtaaaatnctnncaattncancattagtgnnttcnannacctnnccgtnnatatctgnnntccatccacaaagnccaatcnnngnatcncnntntnantatncnntagagnncnccnnntcccatctatcgnctnnnnnatnctnggaccnnnntcccatnccannnngtnanncngantnntgtgncacnnntgngnncngcatctcaancatcatctcgtctcttgacgatntncttantcggcgcattaggntcnatcgnntantnngntcancacctantntaatctcantntnatcanntctacctatntcatatcngccanacagtctcnctctaaatncnncgcanngcncatntatcaantcannanactcntatanctcacatntctcnngngncatntactctccnagctctgtcatttttntcatctntctctctgatacagccacntnggaaaactagcnnctcactcacnatagccnnatctatacgctcnctntcnncagngactcgatanatgcgtgcgtgntcnntctatagcnncnnnctcattngcatnananatctcnntcgcgcnactgttgtcntcatcttgnnncantacantgagaagtnttatatatagcnacnananatatagactcatctcactacnnangacgcgangctanactntacttatanacctcacnattngncactntacttatactntcncntntntganacggctncagtatatcgcngggntctcacttactntnngcncntncactntcctnngngcnnnnaacagtatntacactctatnaatcncanacgncnactgctccattctgnnccaanntctcntctcgcancnnnntnnnnntcgnatnngcncgatcattgncnnnnatngngtcnctctncannactnctctctngncngccanccacnnngnagcntctcnnctatnncgatcntnngncactnantaaacctcatcacatcntcntctctccncncntnnnanatctaccctnntnttnaatgcntnatgtnactccacgantatntcncactttatcnntntccnctntatcgnnnctctnttancagtctcnacttattngctctnnngnccnacnnttnagcctcnccgnttnatactccntcncnatgtccgntccncgnagcnncatangngnntnnnntatcntatacgntncanantcgacnt

SEQ ID NO: 4987 - DNA, 769 bp, Homo sapiens
  misc_feature (1)...(769): n = A,T,C or G
tttctaaatggcttggntctngttctttctncangatcccatgcgattcgaattcggcacgagcccagagaagagcttttcagagaaaggtacagacaagaagctagaaagagtggaaggagcagcagtcttgcaaggaagcagggcagagacacagcccatggcccctcactgccctgctggaagggctgatggagctccccgcacatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggcttgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctggggtcttaaggagcctcctcatgtctttaangtagcatcattgatctttggatgtggcttttggattttctgaacaagctaatgttgtgtcaaagaaccaccactttgtgatctcatnggctttgattgatttgggcttgttcaaaatggttatttgaaaaaacgtntacntttaataaaacttancaaagagattntaaaatcccganaaaa

SEQ ID NO: 4988 - DNA, 795 bp, Homo sapiens
  misc_feature (1)...(795): n = A,T,C or G
ttgtacntctttttnnaaacccntngctacttgttctctttgcanggatccctcgattcgggaatctcctagaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactcctcctgangaatggtctggtngttgcttctaatacacgattgcagctncatggngcaatgtatggaagtggaatctatcttagtccaatgtcaagcntatcattttgnttactcagggatgaaccangaaacagaaaggtntcagcccaggacgagccaccttcaagcngttaanaagccagcaattacattcacagtcnccaggaaanaaaaggncagncctatcccccctttncctggcaaaaggcccgtnaaccttaaanaaactgcctttagccctttatnntggaaagtggattcncncttnattcttggacccctgncn

SEQ ID NO: 4989 - DNA, 737 bp, Homo sapiens
  misc_feature (1)...(737): n = A,T,C or G
ggaatngcttncnnnngctcttgtgcnngatcccntatnnnnngcgccaccgtgcctggctggacatgtcaatttgaagtgaatggttaancatccagctagctgaaagcatggcagaccctancagaaaagctncagtgtgtttntgcagctatnaagngaatggnttcctggggaaaattgtgactttgnntaactgttgttgaaaccagaataaattatatttcacttgcatatgcataaattattaaaattttcagaagtcagtgatacagaagtactatnttgcaatgtnaatctgcttgagtctttggagaaagtggtttcattgtangtacatagngcactgntaatattttaaacaagtnnttnactcttccatntaagggatagcatntccttgtataaaatgactggatgtgtataaaggaattatgttgtcatgtgcctttaaccagctntantcattactataatctgatatttatgatanttcnggnnngtgacaggaccatatgaaaatntcttatgtcancncatcactttagattntatnattatgnacattactggggtnttancctttgctaatgtgaagcnttcttccctantaagtctacattaccttntgctcatttanatcatatatcacnataactttataantnatctnanaccnngcccttgcctnttanactttcnnncgcncattaccgtagatccngacatgataagaa

SEQ ID NO: 4990 - DNA, 772 bp, Homo sapiens
  misc_feature (1)...(772): n = A,T,C or G
tttcntaantgnntnggtnctcgttctttctncannangcncntgcgntncgaattcggcacgagcccagccctagatactggcactactgaggaggatcgtttaaaaattgatgtaattgactggttggtatttgacccacgcagagggcanaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatgganggtggatggtggatgttagagaggatgccaaagaangaccattgaaaagaacacatcaaatggtcttacctgagaaagctttgtctgcccatggtnngttttctggttcataccnatattgccaantactggtcaatttcaggaatgcctacagttaccantatggnatcctntnagcgccacanactggacctggtnt

SEQ ID NO: 4991 - DNA, 828 bp, Homo sapiens
  misc_feature (1)...(828): n = A,T,C or G
tctatcccttnctcaatccnttatccngntctttgcaggacccatcgattcgaattcggcacgagaaagcannaaaaaaggaanncacangnttttntncccaaagttgttttctagatntgtggctntaanaaaaacaaaacacaacaaacacattgtttttctcagaaccaggattctctgagaggtcagagcatctcgctgttnatttgntgttgttttaaaatattatgatttggctacagaccaggcagggaaagagacccggtaattggagggtgagcctcggnggggggcangacgccccggtttcggcacagcccggtcactcacggcctcgctctcgccttaccccggctcctgggctttgatggtctggtgccagtgcctgtgcccactctgtgcctgctgggangangcccaagctctctggtggccgnccctgtgcacctggccaggggaaagccccgnggtctggggcctcctccnactgcgcncactttgcaanaataaactctcncctggggtttnnctatctttggnnctctnaccctggtnaagaaacgccaangtggttcccnaaacgnctntncttgcaagaacaaaagtacccccttgcnacccttcctnatgggcntcaacgaatntaagggaagggnccccccaaggccccctttcctggngttngnccngntnaantnntttgggnccngcnttttccnaaacntntttatnngngtnccaanccccttaangccanngttcccngnggggaacaaccaannggcccctcaagccccaanngcccctttncggggggccccccnt

SEQ ID NO: 4992 - DNA, 1499 bp, Homo sapiens
  misc_feature (1)...(1499): n = A,T,C or G
cancncancaccanacacacantcncnctttttcactttttttttccccaanaaaccgancncgtttcccccacngtctcaacccnctacacncngcgcnanncgcnacacacccccgncaancanccnnnctntcnacacncncaactacactncatacactcnctacnctacncacncacatacaacaacaccacacatccncntaacacacanacaccaccaccaaatcnnancccnccnannnncaacannnccatncanacacnnacaccacacnccancacccacctctnncanccacacccctatctccncnacacnaccacaccaccccgcaaacnnncgccccantcncantnccncncacanacacacacacancctcaccaccnacacccanacacancccccnacncncaccacccaccnnnccncccnnccnccaacactacaccaacnccnnnatcaanccnacnaccanccanaccnncaccncccctcnaccccncaccnnancacctcacacccccacccancnccacnaccccaanccaccccccacannncttntnananaacanccaatncccccaccccncancanncaccacnacaccccccccccctaanccacncncacccccaccccncacccctanncnacnnccnccccacnaacaaccncaccnacaccncaccntcccccccatctcntnacncccccgcctcacccnaacccacatctnctcccacanctccaacacnccncnanacacnnncacacncacaacaccctctctcncacnctacantcanncacatacacanncatcantcnctnntncncccaactncncactaacctngcanccnacnctcncnctcctcaccantcgcacncccacacccctacccatactcncntccnntntacaccatnancacaccacacnntncaccacnnccnacnncanccncnntacancncncancaccacacctnacgcacaccctnatccacancacgaccacacncccctnccacaaaccacangaccnncccctacacatntaccacgncctaacaccaacnnactctctaccacgacaatcncctctcaaaacacnnnatctntatancancccancacgtcacacncnctnnaacaaccncacatccagtcaacatnaaccacacatncccancantncatctcacccnntacnactcactccactacnccncctctccnaccacnccncctccctatncaacactcancntcnaacactnctcncccncntcccnccccaccacncntccngcatcnncaacacccacctacaccancacnncaccnccccccccnacccacacatcccccantaccatcaacaaacacataagcatnccactcccaccanaccacccnatatactntacncctctccccacacncncccccnnaccatctcacccccctcnccnccncncn

SEQ ID NO: 4993 - DNA, 1576 bp, Homo sapiens
  misc_feature (1)...(1576): n = A,T,C or G
gncctccctcntcttncntttttgtttttngtttttccnaatcncctttttcngccacatttnttgnncnnggnatccccatncgnntttcggaatttcgngccaccgtagtagtangggtnggggngtnctgggcccancatnanggtantcctcntnntcgngntttcttgnnctctanagggngtgtacnnncactngtctnatgggccntacgcaattctaatcngttcacnatgtcancancatcatgcnacnctnnnntacttctgcnaacctacctctnccnnttcncaangccactggacnctcantcacctnctnnacnacanngntttcccancncgnccttcttcattnnnctccatnncactttnncncncnctcacantcntcccatcnttntcccanccactcnnccacancctncntctaantcttnatcanatntcactctcattcatnnttcacccnactgtnnancantcccgnctctacatgtcntanccgatnntcntnctncaactcatncannnccttngcgccttatcaaatactcntacnnactnttaccctactnntnctntcancntctactntccctctcctccttctatctcaccatacacctctatcngancntnncatcnctatcnnctatccanacnnctgtnactcgctntcactctcntntnttctctcgcactaacatanntcaatcccanctctcntacctgtcantccncagctctgatctctcncgtanaactcctactctactacactntctacnctntctntacgacacacgncagctcactctccactactnctncctncacncctctccgagncntnctctccnnntcnactactatctnnaacgtcgcttactnacnntcnctccanattnagttctccanctgtanncatctcgctttnacactcancnnnccctnactcgnactctcanactctctcngcnctatctcacacaattccgtnnctcnancanacacnacnatacgtngcttcatncncntcaagtanattncancatnatcnctatntcttctatanctattnnganncatacnctcatcggcanctcacactctatnanctcnntacacacccagngtcatacntcttctgcnagtntcnnncntcgacgcannnccatctcancactcananttctcacngnacgtacacnccnatctctcnnngccnccanntgactcatnacctatctntcnanctctncgntctcnnctccntctctatcctctctacnctctntctcttacgctccncnnntcatctaactcntacnntcacnnctctacatcttcntcatctcntcntctatanttcttatcgntnnntactncnaccagcntctgctatccttgcttgnactccncnncatcgaccncnctctcatngntccacatcntcntctntntactcgtcatcactctccnacnccnatatatctnttatcctnanancncnncaccgcagngcaccactcanntcnnatncntntannacnntcccacntctgaccnct

SEQ ID NO: 4994 - DNA, 796 bp, Homo sapiens
  misc_feature (1)...(796): n = A,T,C or G
gnntnnnnntttnncctanacngaatggttgggttaacgccctttcnnnangnagnccngcgntncgaattcggcacgaggccaaatgccggaattcaaaacctggcttttaaaaagaatgnttttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgtaatgctttatggttaccaagttgggctgtttaagaactcaaatgaaaatcttttacctggatacctcaaaccagaacaatggttatgatgtggaccccagtccctaacacagagatgtcttgggataaagagggtaaatatgcaatggcctggggtgtttgtgggaaaaagaaccaaaccgtatgggttcgtgtagaaagcaaccggcattatgccttcacatactgggaagggccantgggtgccagtagtgtccngctnggcccttccttgaanaactggattcnaaagnt

SEQ ID NO: 4995 - DNA, 815 bp, Homo sapiens
  misc_feature (1)...(815): n = A,T,C or G
tnnncntttcctaatgctttcctaantggcntgggttctngttctttctncaagtatcccntgcgntncgtataatctgggggtacagagcaaggaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattctccgagcttcgcaatgccgctaaggacnacaagaagaagaangacgctggaaagtcggccaagaaagacaaaagacccagtgaacaaatcccggggcaaggccaaaaagaagaagtggtccaaaggcaaagttcgggacaagctcaatacttaatctttgtttgacaaagctccctatgataaactctgtaanggaagttcccaacttttaaaccttataacccccancttgtggncctcttgagaagacttggaaagattccnagggttcccttgggccaggggccagcccctttaaggagcttcctttaattaaaggaccttattcaaaaccg

SEQ ID NO: 4996 - DNA, 753 bp, Homo sapiens
  misc_feature (1)...(753): n = A,T,C or G
tnnnncnttgacggatcttngcagnactnaacggcaanttccctctttttgcaggatcccatcgattcgaattcggcacgaggagtaagggcaggggcctaanaaacagnttttgttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgntgctgactttgccccanaggttgcttgggntacnagatctggcaaaaccgagctggcanaaccaattgccattcgtcctactagtgaaacagtaatgtatcctgcatatgcaaaatgggtacagtcacacagagacctgcccatcaagctcaancagtggtgcaatgtggngccgttgggaatcaagcatcctcagnctttcctacgtactcgggaatttctttggcaggaagggcacanngcttttgctaccatggaaaagcaacggaaaaggcttgcanatcttgacttaaatgctcaggatatgaagaactccggcaatncngnngtnaaggaagaagacggaaangaaaaattcaggangagacttncactccatagaagctttattctgcc

SEQ ID NO: 4997 - DNA, 711 bp, Homo sapiens
  misc_feature (1)...(711): n = A,T,C or G
tggtttanatcnngctcttgttctttttgcaggatccctcgnttcgaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaannaaaaaaaaaaaaactcgagcctctagactatagtgagtcgtattacgtagatccagacatgataagatncattgatgagtttggacaaaccacacctagaaatgcatgaaaaaaaatgctttattngggaaatttgggatgctatngctttatttgnaccc

SEQ ID NO: 4998 - DNA, 786 bp, Homo sapiens
  misc_feature (1)...(786): n = A,T,C or G
ngntttanntattnncnttgcgctttgngaacttccngcanganttcgcgattcgctgaaatgtcanacacggccacctaggcagcatttacaagcaaganttttctgctnttttgatgtatatcttaagcgcccccagtgaatgaacagcatataactccacataaaaatcattaaatgtaattgacttccagagcaggcagntctgttgtatgcctctggagaaggctggctgaattggaattggnctgtaccttctgcctatcatgtacatgaggcttttgggcaaagagaactttccacaaaataagtccaaaaattatagatcatcagacaaccaataacatattgatgagatatctccaagatctagaancgtcctgggtgtcaaggaagtcntttggggtttttacaaatattgataatgcactttctataaaatgcactttttataaaaatgcatgctcanttgagacaacttgaaaaacacnaagaaaaggcccgggccgtagtggctcacgcctggnatcccagcantctgggaggccnaaacggggtggatnaccgaaggtcangagaantgagaccatcctggcnaacatggngaaaacccccagactctactnaaaaaatacataaaaattancanggtgtangntgncggggcgccnatnagncccantctactnaaggaggcctgaagcaggaagaatggggtggacccnnggaanacngaaccttgcantnaaccggnnatcccgncactggnacctatagnctgggngg

SEQ ID NO: 4999 - DNA, 1251 bp, Homo sapiens
  misc_feature (1)...(1251): n = A,T,C or G
acgagggggctnccccttttttttngnaaaaaaaaaccccccntttttttggggggggnaaagnttgggggggctttttccnaaaaancncccnttttgggcanaaaaaannncccnnncnnacccnnnaccannnnncanannnngggggcncncncgnnncnacancncggccacnancnnanancnggngtggntcacannannacggnngggggntcnccanccacnnngggtnctctatcncggggngcggggggccncnggggnnncgngnatcaccntggggnggncncncacccgggggggnncnccnngcngngccacccataggggggncanaatggnngccccnnncgnnncacanccaaggnngcacacntancccnnannacaccncccacacctnctncnanaaccnannnacanancnncnnaccnaacncnacccancanccacccccaccnncncncncacccacnacncaacccctccancnaccncccnanaacaaannncccccnacantcnnncccnncnnnaacncncnancccnnacaanccccattnnaccnanacncncanncnactaanacnctnnccacnnnacanaaactntnnacncanccacncnacccccccncaaccccacccccaacnanacncncctcccccataccacaacacntnccanctnacccctnaaacnanancaaacatanaaanccacnccaccncaacccaccaacacnnctaannccaccaacanaaaccnccaccacanacnaccncataccancnnnacacnatcaccnnacnacaccanacccntactncaccnntcnatctcnnnncatncnctancacnacacnnnaacctcacacacnncataccccancannacacantctatacancnnctcaacnacccncacatcctattactnnacancacnccnatnctcnaancnncncacaanacncnaccaacacncaaccatctcacatctncacncnaacnacancantctcncccaacacaaatcnncnccnaacnctccncanacntacancatacacacnnactacaacgcnccaccccnctctcncaacacncacnntcatnnacncacntccnanacnctnncacaactaacatncccacnanacacacnananacacacccannncaccannacaccnaaccntcacaccacnactactnncaanctnnncncacatnncncc

SEQ ID NO: 5000 - DNA, 787 bp, Homo sapiens
  misc_feature (1)...(787): n = A,T,C or G
gnttttcctaggnatnnctttggcacttnctctttttgcaggatcccatcgattcgaattcggcacgagtcgagttttttttttttttttttcactttttaatacacttcaatggtttttaatatattcacagttgtacaactatcactagacaaaatatttttatctgtatgaagtgctgtgtgtatcatggggccaagtcaggggaagacaggagtttaccaggggaagaaatgcattccagggaaagagaacaaatgtgcaaaaagacggaattctgaaatgacctagcatttgcataatatgaaactgcagggggaggtaggctagagtttatagtgaggaaacaattgggctagtttacaaatgaggaatctgaagctcaaatagatgaagtaactggcataaggcaattatcttatgctaactcaagaaaaggtgtctaaggcaggggtccccaaccttggtgccatggactgggtactgtggcctgttaggaacccggctacacagcaggaggtgaggagcaggcaagcattactgcctgagctccacctnctgtcanatcaaccggnggcatcaaattctcatcggaacttgaacccttatttttgaactgcncattgttanggataggttgcattgctcccttatgagaaatctaacctaatggcccggatgaatttganggggaaaaaaaatttcaatccttgnaaccacccccccnaaccttgtttggngggaaaaaaanagnctttccnntnnaaacccggncccctggggncct

SEQ ID NO: 5001 - DNA, 900 bp, Homo sapiens
  misc_feature (1)...(900): n = A,T,C or G
nggntcttttgnaatttctaacacctgctctttctaatnnttggaatccctcgattcgaattcggcacgaggnaanaacngctctggagaaggccacgacannncanaganntcaagtnagaaanccaccagnctaactnnaggattnagnancctnnnnancgcnntnaggnncaatgaggctgaccttgaggctcttggnagggaacacttgncggcacnnagctcttgtgcgtnctnggtcactttgntcntatccattctctgacaccccagttnnnattaancacccnanntnagantntctgcnnggtgccnggcnnnttnttacnnangcccttctncnttnttcnncannatccnccnntttccntnatcntttggntcggatananntttnctngnaanccnttngnttttctttnancantnattctnnancccaaaatttgctttttnngtcttcttgnatttttcnctnaattgccctttcnatctcctttnatnttnatcccnttttntttttccctngcntttnccttcatacngtnttcccttttnttnntgccnatnttncaatnggcncctacttttatcccnttnngggcttttttgtccncttnntttttttcttccnanttcctcccttatttctcnaccctntataacntacntnatctttctctaaattnccccnntttcttctnttnttntccctntttttttgtccancntacatacttcnntnnttttnggantctcnncctatttntntcngnntcaatctatctatcccnntntncnnttnctncnttncnntntcnnttctatnntnnttctnttattnncntntnctnttagttnntcttttacntactannctttttcnntttntnnncg

SEQ ID NO: 5002 - DNA, 734 bp, Homo sapiens
  misc_feature (1)...(734): n = A,T,C or G
gtnnctaaatggcnggcctgctcgttnctttctcgcaggancccnncgantcgaattcggcacgaggcggnncggtccngtacatggctctgtntgtcacaannnnacgcnntgnntgcccgttcncnatacnatagtgnngctntgtccaaatcntggactctgccctcnatgaacttgtgctatccagatgaccnngctacatcactgnttgctncnngtactngcannnnncacgnaatgtggnantgnatgganacgntgaaccttttcnnactatngcccntncttntgnaatcannataaccctgtttggnactnttntngggctnctattcctggctgnggtntgnctnacactgaccaangggcctgtgctgtananatgcnannntnntncagngntncctngtnactntnntaaggcnnatttnatntganantnatgcacnattngcccagtgagcnncnagttcagngnncgcannatggngancgcngtgcttanccnagntctgtgnnaggctatgcccatntcaaggcntgcatggaactatgatggnnncannnnattcnangcngtgtgncngaatgagatcctngcacaaggatatcatncntncagtnatggctgtncaactctggantctangcatgttccgannntganggnancagattnantgngaccctgactggtgcnnngnancngnacattgaaaaccngccgctgc

SEQ ID NO: 5003 - DNA, 934 bp, Homo sapiens
  misc_feature (1)...(934): n = A,T,C or G
nggnnnntttnaaaattcttnatatacngctacttttcaaatnnttggatcccatcgattcgctggcggtaaggctggaaagggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaanaattgggttctcttattaaagggttcnattgctggtggtgggggtcatttcncacatttcccnaatnttttgaattggggaanaaaaggnccccccnaaananttgtcttaaaaggattccctgggatttccttgggtatcttcaaggacttcttnaaatacctctttaacaagcttgtnccaaatggtttgggtggaattnccanttgggaccttggtattcttcttggtggnaaaaaaccaccaaatttttggccctttttttgggnaaattccttaattttggaagccnaaatttggggaaaagnttttaaaatttaagncntttttcccaaacccaaaacccnaaaattttcttggccantttccnaagttcntttaaanccntttnttttnaaaaatnggttnaccttgggggggcttttcnaaaaggaaaagccttntttggaanttcttggaaaanttaattggggggttttttggaatttggaaattttggacctgggnttttttnaaaaaaaacctgggtttngggaatttttaaaattggnggaattncncnaaaagtttnttnggtnaanccaaaccn

SEQ ID NO: 5004 - DNA, 757 bp, Homo sapiens
  misc_feature (1)...(757): n = A,T,C or G
ttnnnnnncncagcttcnngttctttttgcaggatcccatcgattcgaattcggcacgagncnngatggnnntgaatgncangnntatnncagatgagacaagnganacaattgtgtccntgtantctntnnggngncntngntgcnggngaaacatnaactatnggcangntaactgnacancntagacccanngatncnangncaggncantantgggaaccnccantnanggntnttttnnctatgntcacagcnnncacangtnnagnctgangnntnananngacnnangaganannncattttaatngntnatgngaaaganggnnaanattgnccnagagnttagctcttnacantactntagtcntgcaaggagtagccgtgngccngatcagngaangactgagnnctcananctacccngcnctnactgnatgnngactngcatgntnancnaanntaacctgngagccnncgngcnnagcctntttgtnagaagncnantcngtnntncacntgcccnnagntagcgctttnngnntnacngacaacaccaactgggntggtggcctntgtcnganttngaananangcnntnacntgcnngctcnttantgaaggattggatactgananntacactccngacntttgcnaaaatggaaaannantggtctctngganggnaactnttnnacngnganctgttctantaaaatannacgtggatgaaaagcttactggncacngt

SEQ ID NO: 5005 - DNA, 757 bp, Homo sapiens; identical to SEQ ID NO: 5004
  misc_feature (1)...(757): n = A,T,C or G

SEQ ID NO: 5006 - DNA, 779 bp, Homo sapiens
  misc_feature (1)...(779): n = A,T,C or G
nttngaaattccatatagnantgaacgggaantcccctttntgcaggcagcccatcgatncgaattcggcacgagaagangtttgattctttagataacncttttnangtgctataaagggcctagtttaaaaggaacttcttttgaaaagcaattaacagttgataaagggttaaataaaaattatctagtaaggaatttcttattggaatgtaaacgtggttctaattttaaatagacagtgatataaagaataaaaagtaaacagtgaaattgagttctccagggaaaaggcagacctgtttagtaaaaaaaggatgcttttttcagtgatgtctttttttgagtgcatatgtgtgtgactcttgaagaaatccatgttcagatttatcagatgattgaagtgggtgttctgaataaagaaagctgtgaggcctgaggcagtgaccgtatcaggaaacatattttattggagatttggaagctatagtaaaacataatggcaataagccaacttcccagtggtaaacccacagnggtggnttagttctaacctcttgatgaccgaggaggntaataattggatattgcagagcagcaaatatgtaaccngngngtaatctcanggccncangntaancagnttccagncagaagccntagaagaaacccctgaccaaaatttagcttaccccggacctangctgccngcntatgngggncnggggttcntcngggtttaaaagaaacctaataactgnccacaanaccnttgaccg

SEQ ID NO: 5007 - DNA, 820 bp, Homo sapiens
  misc_feature (1)...(820): n = A,T,C or G
ctgnnncnngccgatccangtagaactcatgggaactcccgcaggancccagggngncgaacgnggnncgaggnaccgcgagagaagggngggtttaactacacacttttnaaccntgcttaacanaagtattatatangnacagtttcatacaggaattacctcaaaagggagtctnatgangagcaactacagatagntgcaagggatcatacagaagatatcgatgataggtgaaanatgcttagaaggggtgtgaatgtctagcngngacnaccatgtgtatgtatccttgacaagcagtataaaataccngtgangtnttctttacattacgggataangcataaggaatcaatcnccatatanactatcanccctaatgnagcaaggggaagtatntaattgcccatgatatgtannttactnatactatgccagagaggaaactataaagtaattacacangtaaacttgggtntttcacanacgnaggtattcattnngagtacggtgaagaagaaaaangaatatcnaaatgaactgaanccngatggganagtatcaacaagtntntaaaagcccaggattctaaaaaacaataaaggggcacgggcantttttggagtnngnacanccttatgccnantggcnaanaatnccaaaaatnaaaagcggnaaccattggggaaccccgggtggaccntaaanggcnacntaaatnggggaaccagcnantngangaatganggaaccaaaggggggttaggcaaataagccaaaacccccaanaaaanantnnngggnccaaaannncccg

SEQ ID NO: 5008 - DNA, 752 bp, Homo sapiens
  misc_feature (1)...(752): n = A,T,C or G
agagnnnnnntttnattctttgnnctctaanagcttggctactngttctttttgcaggatcccatgcgattcgaattcggcacgaggccaccttctaagcaagtgatggcctggctggttcagtaccctttgcaccctgctttttaaatcttattctgcacactttttcatatctattcatatgattagacatcatcattttaatggcttcatggcattccattttatgggtatattataaagagactaatacagaattatgttccttacaatacatgatttttaaagttttaaaagctaactggggttacatgccctcaggacaagacacataaacacattttgtngacaaaaaanaaaaannaaaaaaaactcgagcctctagaactatagtgagtcgtattacgtagatccagacntgataagatacattgatgagtttggacaaaccacaactagaatgcagtgaaaaaaatgctttatttgtgaaatttgtgatgctatngctttatttgtaaccattataagctgcaataaacaagttaacaacaacaattgcattcattttatgttncaggttcanggggaggtgtgggaggttttttaattcgcggccgcggcgccaatgcattgggccccggtcccacttttggtccctttagtganggttaattgcncccttggcgtaacatggncatagctgnttcctgtggggaaaatggtatccgntcacaaattccacaacatacgag

SEQ ID NO: 5009 - DNA, 809 bp, Homo sapiens
  misc_feature (1)...(809): n = A,T,C or G
tttnnaannnncagcgtnnccnccnttncnctncgtgaaaccctttggcaannccccccnnnnngcaggatcccatcgattcgaattcggcacgagattctctcaataatggccagccgaaatttcncgctgccaggcatctgcctccgcggggtcattaaactcccacagtggtcaccccactgctgatgtacagactttccaggcaaagcgccatattcatcaacaccgncagtcttactgtaattataacactggaggtcagttagagggcaatgcagccacttcctatcanaagcagactgacaaacccagccactgtagccagtttgtgacacctccgcggatgaggagacagttctcagcacccaatctcaaagctggtcgagaaaccacagtgtanaatcaagtnactggacaaacttgaaatcatggtggaagaaacagacagngttagctcatgatnngatttggtnctacctttggccttgagttcttattatttacattataaanattaactggttntatattgntaagacaaaacactggtaaaagtngcaacacctccctnntgcttgtataccataaatgggcagnctctggaaattnatggataaagcatcaaagaaactgcnnnngtgctgaaaacgtttctnnctttntttagngcctnaatttaagatactttactttacncccncntngnaatctgggnngcangnntctcttttanggnntggnaaaanancggncttcgcccctnntaaacttnnagnngngtngggattaccgcnaaaccccngacc

SEQ ID NO: 5010 - DNA, 707 bp, Homo sapiens
  misc_feature (1)...(707): n = A,T,C or G
cnaatgctggtngctngttctttttgcaggatcccatcgattcggggctagcctgcacgcacgccaagatggagctccaggctagcccacagaacagcccagccgcagccgtcctaccagaccagcaccttgtaaccacagtctaacccagcgggcaccaggcggtgagacctcctgccgctgccagcccaggatagcccccttgcctcttgcccaaggctcaggctaccccttgaggcgtctggaggacactaggcttgacctggggagtggcatgatggggggcagggtccgaggcaacggagaaggcagaagtgacttagattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaaaaaaaaaaannnnnctaanantcatnnnannnnangagnntnaaaaaaaaaaaactcgagcctntaaanctntagggagncgtattacgtanatccagacatgatangatncattgatgagtt

SEQ ID NO: 5011 - DNA, 666 bp, Homo sapiens
  misc_feature (1)...(666): n = A,T,C or G
atgtgntaacacacataggctcaangtaaaggggtggcgaaagatctgttatgcagatggaaaaaaagatcaggggtcactattcttgtatcagataaaacagactttttaaatcaacaacagtagaaaaaggactagggcattacataatgaagaagggttcaattcaacaagatttatcctatacacacccaagattggagcactcagatttctaaaactattatttctagacctaggaaaagaattaaacggccacataataatagtgggggacttcaacacctcactgacagtgttagatagatcatcaaggcagaaaactaacaaattctgaacttaaattnaacagttgactaattgaacctaatagacatctacagaatactccacccaccaacaacagaacatacttttttctcatgtgcncatagaaaatactctaagattgccacatgctttgtcccaaagcaaatctcagttaantcaaaaaaagattgaaatcatacccangcttttcagactcctccatagtaaaaaattggaaattcaacaccaagagnaaactntcaaaaacatgggaaacttaaacaacttgctcctggatgaccttttggggtaattgttaaaatanggcatacatnaaccccttnttgaaacaaatgg

SEQ ID NO: 5012 - DNA, 802 bp, Homo sapiens
  misc_feature (1)...(802): n = A,T,C or G
ttcgtnnttccngtagaacttncngcaaaatcccgtancngcangagccnatacgatccgggnccgntgaacnaactagactacgcngcgngcnggcctgtttnaaanantggccagnncttcttnagncngtagctcaaaacctgtgagnatcanacatcanaaatgngngaaanntanagccnntngaanacaacatnngngacaaccnacnanacaanactatggggancagcttntccatgtgangcatagccangatccataacganaangaaaccngaacccnggncnntcncaanatgnaanacncntgcnntgctgcaatgcccngcaaagncgatgaaanaacngggctacatacngcgaggaaggactatgcaactgctnggcaggactantgactnnaanctgngatctnnnnggnactnagaacngaannctnnaaaggnngacagnccaanttnaaaacgngnaaangnacngcnttcgacaacaaggntatncngatntcatctgaacacnggaagggaaacnnanaaccctanacgagnatnnggatngaannnggacnntantannaacgcaccctttaagaacagcttganctcacncnngaaccngccatntttaaccccagccttgggcaccaccaggcaacgacaccagtctancaaagnctnangcnnnnaananatnagcncccagcccngaaacgctgnggccnggaatatncaaggaaaccagaactcttaaaacggtttcccagnnggggaattttaaaaaaggggccaacccctcc

SEQ ID NO: 5013 - DNA, 874 bp, Homo sapiens
  misc_feature (1)...(874): n = A,T,C or G
agcgggnttttaaacccttatnntatncnctnngaaacnaaatcgcnctaaaaggggngggggcgcgagcccntnnccaccccattnccaaangaggnntcantggggtnnggccgngcaccattatccnnncccattcgnaccnntaaancgctctatcaantacaanancatgacctccnctncatctntctnctacncttnctnanacantattnantccacttgattttttttttcttaanactanttatattactgctnctcggngnctgcntaccnttnccatgctaaggctggnacancagncctgngnncnataccgtgnaatccnccagganancnancccctnngnancggaggncccgcannnccccnnatgcnnatagantagttcnanggactnnagntncnatcaacaactnnctngnggngcagnccnnctnnccttnncgacngcccntnanctacgggganctgnatnatncnctntntcatatgnaatccnntnttnnctcggtntggngcacaaacgannnnntactaggaantcttcctnnatagnccntaanannacaangaatgggattaanancttanncccttnggctccanggnagaacancnncataccnnttngggntttngnntaanaantgtcctnannnggggnantaactaangnnacccctantncctnntcgatccccctanaagaantnttcctntatctttctctccaagtacagancncntagnnaaaggntcccatntctatgngnccntncntttganacnctnnctgngngacccactttgnctnngaanggncatnccatntnaancttaaccatnngnttattgnnctcgccc

SEQ ID NO: 5014 - DNA, 782 bp, Homo sapiens
  misc_feature (1)...(782): n = A,T,C or G
agttcatcctttcnaatngcttggctacttgttctttttgcaggatcccatcgattcgaattcggcacgaggttttttttttttttttttttatagggatcacttttatttcaaacaattaaatacaaaccaatattttaccccttcatagatgaaatcacatcttttcaggatatgagtataaagtaacaagcctagggcagagcttgtactgacaaagtcctgaaactacaatgagaggaaacacattgctctacttcgggataagtcatgaccgagactcaatttcagagacgctctatgaacagaggtgcttgaagccacagtggcagaagggaaagatggggaagtgtgccgaagagcctccaggcatgacagacagtcccctgaccaagcacaagtaacaggccctttgggtctctgcttctcactggaaaatgatgaagcctanatctgatgactcctagtgccaacatttaacaaagttcgaaagttatgcaggacttcacacatgtacggaatggctgtatcacagaatattatgccgttagaaagttcacggncactattacctagcttctaaaatttttcagaagaaacagcagacttattaagtggaatcttaaattaaagggattancattttaatggaaataaatggaaaccagagcaggggaacccaaagagcccanttaggggaaagaatcctgaaaaaagtntggntttacaccangnancagcntttgaaagaaaaacccctnttggatttttttcccanaana

SEQ ID NO: 5015 - DNA, 785 bp, Homo sapiens
  misc_feature (1)...(785): n = A,T,C or G
gccccccnnnnnnnnnnttttcaaannccnttnnnnnnnnnngnnnnttttannnnnttnttannnnacagctcttgttctttttgcaggatccctcgattcgattcggcacgagctaccttgggctggccctctatnatgctntgaggggagctgggacagatgatcntnccctcntcagngtcatggntnccangngtgagnttnatctgccnnacatngtgacggagtttaggaagaatgntgccncctctntttattccatgattaaggganatccatnnggggactataagaaaagcnnttttnctgctntgnggncaanangantnacnngncccgggnnanagctcctatgctgtntgcctgcaccaccccctgccttccttcatacctttccntggatatgnatgccagggcttnncacattgcctnattnatactnacntgctnatgaccaanacatncacgtgataacacaaacantgggtgcttgnttctgatcnctagaggnganctnttggnnngntggagnactnaantnttctnagtgtnacttnagttcaatgcctggccatntgcnatnaccttatatcntncaaagaggctactgtgcttttanccttttttaaaacctccatctgtattacattgnnaaccangtttctttaatnaggagcttgacctctanantgggaactcttgggaatggncttagtgaagttcgcnactaacttaacctgaaaattatnatgnnctgtttnacctatcatgttnataactnt

SEQ ID NO: 5016 - DNA, 785 bp, Homo sapiens; identical to SEQ ID NO: 5015
  misc_feature (1)...(785): n = A,T,C or G

SEQ ID NO: 5017 - DNA, 1425 bp, Homo sapiens
  misc_feature (1)...(1425): n = A,T,C or G
cntnttaaaaaaatattgaaggcctntgttgggaaccccttngggggnacccttggancatttttgggngnncccnccttnaaaacnatcaagaaaaataatgggngggtcttttnngggggnnncncnnnnncannnanccnatnnannnnnnnanntcnnnnnnnnnnatntnacatanancnccnccaananccncaccncttnncntnncnncctcnnnnnnnnntnnacncnnacntnnnaanncacnannnnnantnnnncnnaccnnatnccnatnccncnnnncannnanccancnanccnntnntanannnnnnatnccccnnnnnntntannctctcctactccatncnacntncccnaccnntccatctnaaacnanncnnantnanctncnanncntcncnncaaannnaatnnnncncctccacacacantnnancctctacnnantccacnccanncccnncntcanccccncacaanncnnntccnacncnnnctcannacnttaacannacnaacccncccatnaccanaccncccccanncctncnccntnactncncancancannnnncncccnactnnncnccnactcnaacccannanntnntatncntcnccnnnannnnnncaaancnannnacnccncnnnctcatccannntncncncnnananntctnnnncncctcaccanncacncccncnnacanactatctctatacncaccncnctnnnnnannnnnnnnnccancncanacanncnnnactccntnnntannnaaccccnncnacnnnnntcncntnnaccanacncncncnnnnacantantaccnancnnnccnacnanancncncnnnntcacnnnnnnntntatcnantnctctnnctnnatnncnncttctnannnannnccnaacnnnncacccnncanctnatacnantnnnnactnannnncatnancananannnncatatannacacacnntanactacnctacnatncannnactntcncnannanctnncancananatcnnncncnnnnntcanncnnnnanatcnctcancannancncntnanntncanannntacnnncnntnnnnanatntcactcncnannnatcactcncnnnnncntnnnncccannnnnncnnncncanactcnntacnntatactnctncctctantnnnantcntancnnnnctntcnnctntctnctcantcnncncccactctataccnnctnatntnncanntnnnannnncctcctctnccctcnacctncntccacancncncacntcnnnataccncnncnantccatcnacacnatcactctncacncacnctntcnactactantnctcctnaactacanacccancncnntnncacancct

SEQ ID NO: 5018 - DNA, 794 bp, Homo sapiens
  misc_feature (1)...(794): n = A,T,C or G
ggcccccnnnntttttttttttaaaannnccccctttaanaacnnggaaaaaaaacccncctttttttggggccctnaacctttnggccnttcctttttttttgggcccngggggnaatccccccnattcccggnattttcccggaaaatttnccgggggccaaccggaaggcccaggggggaacctgggaatgggaagggggtnccttttaaaccaaaaaaaaactnttgttgggtngggnccannnnannnanananananannnnnnnnaaaaatcccttaaaaaaaaccaaaaaccaaaaccanaaaaaaaaaaaccaaatttctttcatttccanaaaaaaaattattctttanggggacctggaatattgggtaaattatgggtcaaatntaaataatattttggggcattccttacattgcttgcaagataaaatgctgtgccaaaatttgattttatttggagacttcttatcaaaagtatgtgcaaaggaagctaggatagagtgtccatccttgttgagtgnttctaaaatntnttctgatgcatattttacttggtggggagagatgnccagctcctctgtcttgaataacttattgcttgttncctaactttgtagaatggctttcggaaaatagaaatctntatagtnagataatgataatgttcttattatattgactgcaatgcaataaaatctttgntaaaaaaaaaaaaactcgccctaacttagtgagcgtcnanancgctgaagacattgtgagtggcacccactgatgnggaan

SEQ ID NO: 5019 - DNA, 957 bp, Homo sapiens
  misc_feature (1)...(957): n = A,T,C or G
gtnattctantnnancnctttcacnnaccnggtaccccacccgggtggaaaatcgatgggcccgcggccnctctagaagncntnngtgngtcacangnttntccccctatggcctcacaaagtgctnnnattatacgcgtnaatccantgngnntggcctanagtnnnagtanncatgatttnngcnntgttnnngtcctggnttccaaangnagnggacctagctgntnatcaattnttntgagctaaactgnntagntccannncctnntgatantctccntnnannatcgaggtatnactagattaactnggnaacnnacanggatcanatncactnataatanacnnnatnaatnanntcnacactnatccnnctttngctnnatatntgnanaancaannnactgaaaacntntattnnttaaagnnntncgncttnatgactcagttnccnaangctntatnnntattntgntgtgtnnatatccaanctnncnnccnnnncnttgtttgtnntgctcntnncngtttcaaanagaataanaannctnntnnntnnctaagananacattcntnagctnactatncnntactcnatnatnattntatgccaanantgtagccntccnnatntatnnctaaaaanttnacgnctatatannacngnaccttnncatanccggntntaanncnggtntngatctcncatnatntcctataaanngtgtntatacgttnactcccaatcttnccntacgtgaaaaccnttntttctcattnaatnaaaaacggtgtctaaaaanncgaanntnacccttgctgctcttcatcgnaatntatacnntatcntatcgnatnttanncatagaatncntctcttaaagngcngncaatnacnnaccntncgncttatgntgntngattccccctctntcanaanncccnaaaanncc

SEQ ID NO: 5020 - DNA, 808 bp, Homo sapiens
  misc_feature (1)...(808): n = A,T,C or G
gtnttcctttcaaatngctnggctacttgttctttttgcaggatcccatcgattcgngtagccgaccngctgctgtnncnggtgcttgntacgaacgttgccacnannctgagantngtnacnctaganctgnaaacntnatngttnnctgcctgnatnaccnagnaggctnnnatactnaagatngcaatnctgannaancctgcntnatgtncnnnngtctctnantaccagannnttgannnnttactggnttattagatggctattatctctaaattcnggatgcctacctggcttataacctnaangaattnactggagnactcntntatgatnttctgcccacctgtgatnntacccatgaacacgctntggatactgngaaatatcggatntantgccatcctgcttnatggacntntnactnagantaagcgcntaaganncnttaataagtttaaggccanngccnnntnnattcttctagnaactgncattgccaangcnaggtcaggacatacctnatgtagatgatggatggtcaactaatgacatncctgacccattccangngatcaccntccattngaattgggtcctagccangatttgaagcttgggcgcttacggganaangncncttactntttggttaanacaagttttgannggttgggnaantttttaacaaacgccatttggaacacttttaattgggngaataaaacttcccccgggtnttgggaaaacncggattgntgaaagggtaatgaatgggtnncctggaacggnggtaantttggaa

SEQ ID NO: 5021 - DNA, 788 bp, Homo sapiens
  misc_feature (1)...(788): n = A,T,C or G
cttaannaatncnttatcgcttggctactcgttctttctgcaggatcccatgcgattcgaattcggcacgaggtactntgagtgtttgggggttnnncacacacatgcaattntgcttaacaaaagtattntataatacagnttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacnagcagtataaaatacctgtgatttttctttacattagggataatgcataaggaattaatcttcatatatattatcatccctaatgtagcatggggaagtatttaattgcccatgatatgtattttacttatactatgccatanaggaaactataaagtgattacacatgtaatcttgggtttttcacatatgtaggtattcattttgagcaaggttgaaagaacanaanaaatatttaaatgaattgaattcctgatgggatagtatcaataagtatttaaaanccnagtattctnaaaatattcaggggtangggtcatttttgagtttgggntttcttttncgaatgggtaaatatttcaaaatttaaangggttacaattgggtnncctgtnggncctnaaaggccttttatttggggnaaccagccnttnngaatnnatngaaccaaggggggtttagccaattgccaaactcctataanttgattttngcc

SEQ ID NO: 5022 - DNA, 704 bp, Homo sapiens
  misc_feature (1)...(704): n = A,T,C or G
gnnctaatngnnggctatcgaactnccgnananaacgngcntncgaattcggcacgagaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggaaaagctcccttgtgggagcttcaggcccttcagcgccactaccaccctgaggtgtccaaaagcccgcagcgn

SEQ ID NO: 5023 - DNA, 729 bp, Homo sapiens
  misc_feature (1)...(729): n = A,T,C or G
gnnnnnnnnnnntttgttnctaatngcngggtggctcgnnctttcncgcannagcnnngcngtgtcgaattcggcacgagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaan

SEQ ID NO: 5024 - DNA, 706 bp, Homo sapiens
  misc_feature (1)...(706): n = A,T,C or G
gtnnctaatngngggctantcgttctttccgcaggancccntcgantcgaattcggcacgagctctatcttgtttattgttgatgccatcttagaggaaaaaatgtaaaggtaagtaattaagcatatgacagcaacaaataagatacttataacctaatgggactttattttgtagttttatgtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccaa

SEQ ID NO: 5025 - DNA, 706 bp, Homo sapiens; identical to SEQ ID NO: 5024
  misc_feature (1)...(706): n = A,T,C or G

SEQ ID NO: 5026 - DNA, 968 bp, Homo sapiens
  misc_feature (1)...(968): n = A,T,C or G
gtaccaatgctttgctactngttcttttcgcaggatcccatcgattcgaattcggcacgaggcggacaccaagtctggaccacctcccgctgcgtttnctactcanagaaacatcnngggcggngttaanacacggnatnacnggaagcanganncnnngcancagcnnagnntggggtcctggcnctgcnngctangccaggatgnccatcccnccctttanactgtcccttgnggcctgtgctnntnaaantggtnncngtnagcnctgccngnttnccntattatncccacnctnngcttctnaatnctttatgntccntntnanannaccttnctatactgtancccatcttnctntnaattnnttttcanggatctntnatattntnttncaaantccncnatantnantnattangtntnnganttncattcatattaanttnnantncattnnnctngttnannnttnttctttctnnnnngnttncnnnttcttataatnngtaatttanttnnctnntatctacttnttanttctttcaatcttnaattntntttacatnnnctnctcatccgntnttacnnntntcattnttaactctacctttctcnttctgtnntaacttactnatnatcncttccngttntttatatntnattcnctctnctcataaanctatctntnctctcncnattcttgactttcnctctccntctcttatatctctcgtctcctcncaatatntctctatcctctntcntttcacattcttattntncnatcnttcggnntntctncttnttctctcntacacnttctanacttctatnantcttcactcatnncnctntnnnntcnacatcttacnnnnngtgcttnttananntttanntacatancntantcctctaatctatatntcatannactctattgcttntnttctcnnaatcacacnanc

SEQ ID NO: 5027 - DNA, 782 bp, Homo sapiens
  misc_feature (1)...(782): n = A,T,C or G
gnnnnttnnnnnttttttgggtcttncgcttgttctttntgcaggatcccatcgattcgaattcggcacgagggatcacttgagcccaggagtttaagtctgtattactggaaaggggtcccaatccagatcccaaacaagggttcttagatctcacacaagaaataattcagggagcgtctataaagtgaaagtaagtttactaagaaagtagaagaataaaaaatggctactccacaggcagagcagctccttggggctgctgggttgcccatttttatggntatttcttgattatgtgctgaagaaggggtgggttattcataccttccctttttaaaatcatatagggtaccttnctggcattgccatggcatttgtaaactgtcaccggtgcttggtgaaaagtcnacanttgagggccaacccaaggncactctnattggccatctttgggttttggtgggattcttacccngntttntttactgcaagctggttttatcatcaaggnctttatganctgnatcttgggctganctccgatctcaatctgncatcttaaaacgnctnactgtctnggatngtaaccccaataggtctnaaaccttantttaccccaacttctatttcaagatggaatttgctcttgggttcaaaatgccctnttgacaagcanccagtnaacctnttcancatacccacttggantttcaancctggggtggacaaaaaccaattacccctntttttaaaaaaaaaaaaaannnnnnnnnaaanna

SEQ ID NO: 5028 - DNA, 806 bp, Homo sapiens
  misc_feature (1)...(806): n = A,T,C or G
gnnnttnnnntttttaanggctttggcttgtcntcttaggatcccatcgattcgaattcggcacgagtgaacttgttcattttgttttgnttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctncatggctgtccaccttgtcgggtagcttatcagactgatgttgactggtgaatctcatgggacaccaatcnaanggctgctgacattttgggatctttcantntgancattcanatccaaggtctcanttaaacattcccngcatcattgnttataatcngaaactctgggccttctgtctggnggccttaaaagcttttgggccataatgcaacaattattgaaggaggattttattggagaaatgggggataggccttcatggaccccccaattaattaaaggaaaaactnaactgcantgggggggttttgnaaaaagggtatttantaccttctttaaacnaattccttttttttttcangggacctttttctaagcctggnattgnaccgggtaaccnttggaaccctttctttttggaaaaaaaccatttttccccnaaaaaagggccccctaattttttaaaaaatgggaatttaaccntttttaancccnaaccnttaaaanttttttttttttnn

SEQ ID NO: 5029 - DNA, 716 bp, Homo sapiens
  misc_feature (1)...(716): n = A,T,C or G
tgntnttctaatgctggnnnctcttgttctttttgcaggatcccatcgattcgaattcggcacgagggactcagagcctgggaaggaggccgctatgcagggtagcactgggaacaggagacccacctgaggctcagccctagccctcagcccacctggggagtttactacctggggaccccccttgcccatgcctccagctacaaaacaattcaattgcttttttttttggtccaaaataaaacctcagctagctctgccaatgtcaaaaaaaaaaaaaaaaaaaaactcgaggcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcgcgcttggcgtaatcatggtcatagctgtttcctgtgtgaaattggtatccgtcacaattccacacaacatacgagccgggagcataaagtgtaaagcctggggtgcctaatgagtgancta

SEQ ID NO: 5030 - DNA, 1206 bp, Homo sapiens
  misc_feature (1)...(1206): n = A,T,C or G
nggggncgatttttcnaaaaaatntccccnggngaacggggncaccttgggggncancnccangaaccnnttttgcnaaaaaccccntttggcncnaanannacccnngnnnancgcnctaccnacncgaanccnncncnacnccannggganccnanacaccgcncntcnntntaccanactanatcncncntaaacnacacnaancngcacnnacancacccaccgtatggtaaccnnnccangcacgagcacancacnncnaanagcncgccactaacggggcgggacnacncgatacanannnaccnagnaancnnacaacanacnctacacncgacnaacaancnnccagntncnaanccgccagacnccccanntcangnacaacncccnccacaccacccagannagaccacntccccnnncaccacccnaacnannnaaacnaccctncatcangaaccncccaannncnnccnacncacccnacnnccccccannccacngncnanccnaanagacacccacccccacaccctncncncnaanaacacntnacaccaccanancacaacaanaaccntncnccannacncnnanannnnnccacacnncccnancccnctnnccaanccacaccncncnncnccnacncnaancacncccnanctncactcnacancancacnanccccaatancacaccanccaccaccaaannccactcacacncanactatacagcngacnnnaancacctcananccnnnccnccnncnacnncctcncnccacccanancnacagactcanctnccagcanncaccnncgcccnnctnnctcnnnnacancacncatnagcancccncancgnncacaccncaccaccnnacanccaatncccacccacatccnnccncncctcctatancaancncccaanccgaccgactncanctngctcacgcanacatcncgncgcncntncnacactancnacncncacctnactctnacnatcgcanccatcgntccncncnnancacanncnnannngannatncnnccctccacataccactacancatnacngcnnccnnnatcnnnacatcnacgccaancnccacacgaaccncacgcntaaccatcacgacnaccccaccacgacnngctaancgacnacnctatccaagcnctncgcc

SEQ ID NO: 5031 - DNA, 750 bp, Homo sapiens
  misc_feature (1)...(750): n = A,T,C or G
gagnnggnnnttnngnnagnnnnnnnggnnnnttnnaaagncagctcttgttctttttgcaggatcccatcgattcgcgagttttttttttttttttttttatatatactgcaattttatttcaatcgcacaaacgaagttagcatgtaggaaacttaaatgaaacaaatttaaacgaaatagttacggtaaaaatagcagaaaactgaaaattctaaaaaggaagtacacctaaaagcatgagaattcaacattcattagtgtttcatcttcagttttgattgacacttgatgcttgcaaatttttaaacaaacttttaaatcatgatgactattctgaagagatttcagcaccagcactaagatttgtacattcagtttgtttgcaattgacttgtgagccatttacatagtggatagtacagacttgtcacaggtcagatcacagtgttgaggaaagcagtgccttcctgtcattagaaaggatcccctaaactgtctcagcttaagacatccaacgtacaagagcacaaaaccatcataataatgtggttccaaggaacgtggttttgataaggtaaataacttaggcttctgtttcccattttaattctgaaatctctaataatgacacaactgtcatgtatgatagcaaatgtatataataattcattcagacttcttggaaagaacatttagccaatctgggatgatgggaaatntagcatgattcaacactgggtttttttt

SEQ ID NO: 5032 - DNA, 820 bp, Homo sapiens
  misc_feature (1)...(820): n = A,T,C or G
gtntttnaatttccaactcttgtctttgcggaccctcgattcgaattcggcacgagggtgggtcctggcttccctaaagataattggaagacttcattggattgatagagagaaactgcgtaatttcattttagcatgtcaagatgaagaaacggggggatttgcagacaggccaggagataaggtatgaaaaggatccaccatatcttatttggaattgctggattgcacttttgggagaagaacagattaaacctgttaatcctgcttttgcatgcctgaagaagtgcttcagagagtgaatgttcagcctgagctagtgagctagattcattgaattgaaagttgcatagtatagttttgccattttaacatttctgnatttgaaagtgcttatccgaatctaaaagtgactactggtaatattttgnatattgggttaaattaattttaataaattatataattatacatattggaaagcctcttagaactatagtgagtccgtattaccgtanaatccnggacatggattaggataccattggatgaagttttggaccaaacccccaacctnggaatgccaatggaaaaaaaaatggcttttaattttgnggaaaattttggggaaggcctattgcctttnaatttggtaaacccnttttttaancctggccaatttaaacccaaggtttnaaccaanccaanccnaatttggccatttncaatttttaaagggttttccaagggttccanggggggaaaggttttttgggaaagggttttttttnaaaatttcnccggggcccccngggngccc

SEQ ID NO: 5033 - DNA, 826 bp, Homo sapiens
  misc_feature (1)...(826): n = A,T,C or G
nnctngnngttctaatgcttggngnncntgntcgctggatnggatcntntcgttgccttgtnnactnggcnngacnngnntctgcncngccgttganncacgnnntantncnccaaangtanatgatgtggtatctnatgtcncnatcnangnttngaanaaccaaaatgncctnacntcgnaganaccntgtcncnantnggnnatncncaattnntccaggcntgannnnccntgcctgnncnncnagntacncantaggcctaagcagganactnntttntacccannangtgtaggnnnnggtgacccnanatcnngctnctgnactcnggnctgcgtgacatagctagactctgtctnanantcaagccctcaaagctngaacgtnttatacanaccctgtgtnaattcngangtgaaacgctgntgcctactgnaaatggggatttgggttagcgatnanataggctaaatcacnttntnatacgtgatcctngngtananttctgcccgaatnggtngtacgcntatannaanatanttcnttgttngatancatcttcctaccntanantttctngaaaaanaaagtttggnttttgacnancactnncacnatggnnttnggttgggtgcctgcttgcttggtttgnaatttnnagccccntaanaanacttnttnngngtnctggaatanccgtnnnattccnngacatcatttntagcntcnttgtnttnaantgggggnnannaccnanttgttttnaattcngantnaangaaaaatgcccntntttnncgaaatntttttgtggncctttnc

SEQ ID NO: 5034 - DNA, 826 bp, Homo sapiens; identical to SEQ ID NO: 5033
  misc_feature (1)...(826): n = A,T,C or G

SEQ ID NO: 5035 - DNA, 848 bp, Homo sapiens
  misc_feature (1)...(848): n = A,T,C or G
gnnnnnnnanatcagctccttgttctttttgcaggcaggatatccnacgctaattctgcacgcacgaggctaaggttacannagnatgngttnccttgatnacaggtcactctcncaagatgcgctnnctgcagtcagntgcataactngtnaaannaccnganatagnaccanctttatatggtatgacagtgtnnncagtgggagcaanggtggtccatagcctgcctatnatatcaccnatatctgtgaacacactcatngcagantcagggncagcnatctgntnaatggacttgnattatgtntgnaccntngcttnctgtngacncngnntgagcgcaactttccttanggaccttanggnaccnnnntnaacntactttncanatgatggnnnttntgtcaatcccggatngntncacggtnncnnatggcnaaagncncnacctttatntnacacgttgacattactttacgacnctagtcacactnttggactccattgtccacatncctgntntatganaacnttaaggttttactttacaananntnnaccntggcnttncaaatgatnnnccctgcngacctttcattngcaagggncctanactttttgcatngaaaaattttaggtaaagttgcttttccgcttttagngccctttcctaggggtattaatttgggtggggntccttnccttntactttccccttggccccgntttttcnccnttnnggaaanccccccccttaattnnncccccgtgnttttncccccncccncaaaacccnggcaaaattaaaggggggggaaaattgcccccttnntttaaagcccgaagg

SEQ ID NO: 5036 - DNA, 715 bp, Homo sapiens
  misc_feature (1)...(715): n = A,T,C or G
ngnnnnttnaaanatacagctgttctttttgcaggatcccatcgattcgaattcggcacgagggctattaaaaatgtaatcagtgtgaaaattcatgccatctgaatcgtacgagtatgtaagggatttgagttccttacagaattttctgtaatttagtacttcaagtgacttataaatgtatatacttctctctcacaaaagtgttaggagaaggaaaatcttaaatactagcttgatttcttaatttaataacaaaaaacaattctcataacatgtatcacctaacatgtcactttcactttaaaagtctaaagagttgaggtttatttcttttcttttaaagttgatgtttatgttggtgatttcgaaaagatcagatcccccgttatgaaggatcttaaccttgtcttttagatctccatgagaaatgcagtacatgtagcattagccatatttcttttttagaggcctatgtaggatatttataacctgtaaaagtttgatgacttcatgctcaggagaaagcaagtaattacctagccaagccaggtgggtgttcaggttagtggtaaacagaaaggagatgttgaaagatttcatatctaaagggtaaaaacacaagagaagtatatagagataaacatgtaaagtataagactgntacatagtaagctcctncgaagtggcagccattggtattatttttctgcng

SEQ ID NO: 5037 - DNA, 758 bp, Homo sapiens
  misc_feature (1)...(758): n = A,T,C or G
tgtttttgatcnagnnctcttgttctttttgcaggatcccatcgattcgcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtaatggaaagttttgnatcatagtaatcctgtttccactttggtatctctacccagattgactgtattagatgaaatgtgangatcttggtcaatcggaaaccccgtacctcctctttnctttctctttctttnntttttacttaacattttatgatgatttanatggaagtggtctttngnacttaatgtnggttccagncctttaactggtcaaaatttactttttacantnacattctnaaccttttttaaanaaggggntggggggtggnaaatgcnnnttaaccc

SEQ ID NO: 5038 - DNA, 1278 bp, Homo sapiens
  misc_feature (1)...(1278): n = A,T,C or G
tnttggaangtgtagncttttttttgggaaaaaaaancccccntttttttngggggggaanaggtntncggggnntnttnatancnaatacncnattttttgaanaaaannaccccttntcangggnacaaatatnctaaattnacatctacatnnnaancaaattatntncatcnnatnggacncatantcgacacaccattttntnntancacacgtnnaacatacatntccaccacnntnaanatacctctctctccanttnncanncacncnccttctnntaatacantacancnngaaccccctntcgngggcccnatntatatnanaaancacnctacccatanatcacacnntataatnatcatncnncatacncannctcnnannccaaatgatgcaatnannaccacanactncnntcaatcccnccanaatnttacnccnananccnngnttannncancatacncaanccacnaccanatncntcncnnnacnnnncncncnannannnccancacnnnnannnnnnnaaannacannnnannnanncatncttctnaatatancnacnanaannnnncanacnacaaccactcnngactcttaaactncntananacactncantnnccccaagacacanntncnntaagatggacnacctnntaaacatcnacacctagatcnatnnnngnccccaanctanaactntcaatccntccagcnaacttcaactnnnacnacctnannaaaatctncgcacacnccnatnncacctnacntannnaanntacacccntnctatnanatactcacannnntcncntnttatatcaanntnttntcantaaaaaccacgttnaatatcaccnaactcncntatntcnaataagtacgctcacactanacanacatatatatctacanttttcncnnacncaacanctatngcnacaggantcnncaccngtanaacacctcactatcaaaatngcnancgtatcacnacngcnannagccatnccntacgacntntgncaaatcgaacncnntntaacaananatnanatctnctnnacatcacaantctatatctananactacnngngagggcanaaacacattcccacnnnctanntgtcnccacnataaccgnaatcnccnnaaacacatggnaanatccccactantcgnatcccacncttcaacacnaagancntaccacnntacgtanacnaangancttggggtnnaaanatacttncccc

SEQ ID NO: 5039 - DNA, 796 bp, Homo sapiens
  misc_feature (1)...(796): n = A,T,C or G
ngnnnnttttnnaanaccctnnctacttgttcttttgcaggatccatcgattcgtttttttttttttttttgactcttgagtggattttatttttgcactccaggatgcagtgaagacggtggaaggttcatcttcacaccgagggccctcagtgtcgaggtgactcccggcctgaggagggctgaggcatcctgaattttgagagttcgaggttgaggtctaanaaggtgtacgtgctgtaagtcatgatgctgcaggttcttgtaggtagtgttgtcaaacggctcaacaggcactggggctggctcctgtgtgccgcctcggtcgtcccctgcgcngntgcatcttncatgggctcgccctnggcctaanctttaacgctgctggcttttcatggaaacccngggtatttttcaaaagaactggcttcnaattgcttggtggnatctgatctttcacgaatggctgtncaccttcaagtgggcttctattcctgcgtcctgaggtttcctttntgggcaagggaaggggcccccttgcncttgggcttttggcaccgggtttttncanatgccccttttgncggccccaagaagaacttggctttgcaacttgncccttntggttnttggncctttttttggccaacacaaacaaggccnccttgggctttgccctttcgggngggcnccaaaacaaanccctgaatttttgtggtgggacaagggtnaangggtcccctttnaacctttcaaaaangggctttttgggcttttccttttaaccnaatttcna

SEQ ID NO: 5040 - DNA, 1308 bp, Homo sapiens
  misc_feature (1)...(1308): n = A,T,C or G
ggcttnaaacctttgaacncgcttattcngcggtccancnttngncgngntacgngtanggctgngnntaggcnttncattgcgangcngnncccnnngngnnncnnngttganccnnngngncngtntggntnagngnctacnaacttngaancgancagnnnnnggcnttntgggccgccactgccncgaggnntccanncnctagtcacccnnggngtacccttagcnncncttggntcctctngcaccnnntcntagaaaatncccnncnnnannngncttcttnagtgggtaanntccngttnnttccccccnntggggnncttttngtgcgcacatngcatcattacctntngnnnagtccntacactnatanntctggnnccnnaannancgtatcgtnctntagttnctnttgtgtcgnncntagnnanngntntanacgcatncnttgnnnnatganncntnctcnngttnatctctcatgtngcnctcnnagcnnacgctctctatnngtananncatctcganatcncgcantntaatatnacggnanatcgntcntnnanntattntanntncangcacttcntatgtatatnagntgcgtancgtnngannantnacantgcgactatancatcnggatagtncttnacntcnnanatcctctgcnatangtncnatactcngtatangncnctctatatntaacanagngtangtctntgcgtacctcncnngnantctanncntngggtattcatnatnncaccntntagtnaacnttacncgntgattnatntanccnnattcgtgtnanangacananncnctnatncaangnnntacgtatngcacatanctatgantnncctagatngntcgctcaactatcggcaanctctncataagntgtannttnanantnatgtagtctncctgtnntngaccgctatntnnntcgtanctacncnatccacnnaagananntnttngtngnntnnntatngctcaaanntnggtgttctnaatcccccntctcntttntntgnanagtntgcnanagttantcggnngngtagcgnntntacccctatnggagaggnttctnanttatgcgacatcnccannngannngnnaannacggcngggngnttcctctctggatntatnctcntanctctngcacgnncnnggctttntcanatnaaataccntgacntntnggtganncattngnnacnaangcgctgtgagatagnncccnntagataagtctatctgtatgctnncnccanccc

SEQ ID NO: 5041 - DNA, 776 bp, Homo sapiens
  misc_feature (1)...(776): n = A,T,C or G
gnnnttnnaannccnnggttttaganagggcngcaggttccccanacaanctcnntgcaagancggtagcattcattacctgtttattctctgctgcatcttacagaagagtaaactggtgagagtttatatgggtatatatatatatatatatnanatgtatatatatatatatngacttgctacatgaagatgtaaaaatcggttnttaaaggngatgtaaatagagatttcctnaatgaaaaanacatatngagaattgntctaatgcaacagaaaagccnnngaatctctaaggntcctgtatattccatgtataagtgnaaatataancagacagggntaaaagtggtgcatgtatgtanacagttgcaagtctggacaaatgtatanantaaaccttnnatttaagntgggataacctgctgcatgaaaagtgcatgggggaccctgtgcatctgngcataatggcaaanngncttanaagggccgancggaagatcnatncngacntgacngttganatgtcaggagctgacgacgaggggatacagcgggnganagaatgggcatcganaccaaggggctnanagaagnttccaatgggcgccacctttaaanntgnngattnacacaactccntncagggaatnggngtnnncccanncngacnttattcccagagtgtcccagtattagcaatactgggaatataggcacantaccaatcatantnagaaanntggggggtnaccccaacccaaatttgangcgan

SEQ ID NO: 5042 - DNA, 1105 bp, Homo sapiens
  misc_feature (1)...(1105): n = A,T,C or G
gggggncggnnatnaanngntnggaaactnatcncangatagcgcnggattcngantggnttcgaaaacnctncntnncgatttnaaataaaatntttttcntntttccnctgaggancatnttgaagggnccagnngnnaaanaaataagnatnnngggntcaaatcctancaggctcanaaatgcctgnggttnnnntnggttcnttntngctntccnctcnnatatcanatcctgccntgacntgnnnnnctcntnnntcgcctnnccatcnntgacatcncncatggcatgtancaaccntnncnngntannnnttaaacnacacttgnattgtctgnantgttngaaatnnaacaatngcaaccncccantnnnanngggcnngnccagnncaanacttggnanncttntcannatnatccnntnccntnntncccncatngttantcacttgtataacatttcannncncganctttatatntgnnttnttgnnanngnntanntancntcncnngnanccanntagagatnntggtgcngnnctnccataaaanggtnctatttgctnncacnntacatcagcctanctctnaatntttagtacaggcnacgggaatatttccncnnggnggacaaaatattcgcgngganatnagnttnttttngnncngngtaccccatcccgannattatactnntnnatangngatntaaactctataaagtcnatgtcananntantnaggngagtctnncntgnaaaanaaangnngctcatgatctctcnntatntatnnnatcnctccnannctacaatctntanccanttnacgngcnnnattannngngggncanattncacgtgtccntctaagncccntgtgtctananacnganncntngnantcaancgcnanagngcgacacnccgatactaantntgnacttccataccaattantnatgtntcatnncccgacattaatnagggtcnnaatttntanaatcaatgtctnnncacnanatcngncgtattccaagntnatatntntnaagnnaccnctctagcncnnananncactttnngtcgtntangcc

SEQ ID NO: 5043 - DNA, 759 bp, Homo sapiens
  misc_feature (1)...(759): n = A,T,C or G
gtctaangnancagctactngttctttttgcaggatcccatcgattcgaatncggcacgagcttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcanctggagttgctttgcatttcacagtncaaacagcagactatgtaaataattggcagaaaaattctactttgctgtggaattcccaaactaatatggaccagaaactagctaatcaaatcaattatctncaacaaactgtaatgtggctaggagattgagtagttagtctagaatatagaatgcanttacaatgtgattggaatacttctgatttttgcattactcctcatctgtataatgaaagacagcatgagtgggaaagagttaagaaacatttgaaaggtcatactggaaattnactttagatattatgcaactgaaggaacaaatatttcaatcttctctggcacatctgacactaatgccaggaactgaagtgcttgaaggcgcttcanatggataacagctattacccattaaaatggatcaggaccaannaaannaaaaaaactccgagcctttaaactttgnggagtcnnttc

SEQ ID NO: 5044 - DNA, 1444 bp, Homo sapiens
  misc_feature (1)...(1444): n = A,T,C or G
ctctcncnncnnnncnnntctctnncnntnnnnnntnntnnnnctcnnnncnnnatctnnnnncnnctnnnnnnncntnncntccntctcttntntngctctcntntctcntncatcttnccnctattntcntnntnntcnntcntcnnnantnctnnnttctncctnnccanctntccatnntntactntcnntnntctggctnttntatntggggggtctatttnttnncttaaatcgactngttccaagtctcntancngcntctntctnnctntctntgcnctncnctggggcnttaattncccnngctnttatanaagngngnaattaaggtntcnnntctanngctntgcaaggctaatgnttagatccngntagaanncgntacatgttgggaacngacancttnctgcncaaagngggctnaggcanngnnntntgcaaannctcnnntntcnnancttgnntcncgtagancggnnncccctgaattttnnancnnggancnttaaatnntntngnggtacgannccncnnncgnnnnnncgnntannccncanngttaantgcncccnnannnantcaactctntnntcctnntnnaacnnnnttantctannatnnttacnnntnagnttttcctcnctnacnnctctgtncttnttnnatcttntncttctcncttnatttntatctcntntntntnctnccctnatctatctnctacnctctnttccncttctccctnncntctctcatcatatcccacgcnactnancccctctnnctcttacctnnntnctctcntcntatctcnnnaccctctttctntntcttatnncncctatcctctacttattctcctcctattntnccactcacccttcntntntctncnctnntcttntnctatttntactntcnctattcctncntctctnntgnctcccaccccctcttcctctcnctctcctnnnnnnactactctcaccntctcnnctntcnctctacnnntnnananntccttantttcctnctcatcacantactcttccctctcatnntcananctaanttntnctctcactctaccactctntnctccactcatatnanacttctatantnctaatcctatcttcttaaacntctcctcttatcnctctaanctcctcttcntcgctanctccnntncaactcgnaaatctctccaatnctnccccactctaaaaatnncncntcngantcccacttttcngngcanaatnnaacncnantccnctccctttagctatctctctanaaaccccntttctcaacaggnaccnccctntntctcnaaatcctcatnctnctactttatatntcnccaagcctcncctntgtaanagcatctcnctntccnccaatnnanatctccctnctccnatanatntnanat

SEQ ID NO: 5045 - DNA, 1027 bp, Homo sapiens
  misc_feature (1)...(1027): n = A,T,C or G
agngnttccttcccccctttatttngaaaaannggcgccctnnttcnanaattggccactttttcctggtccnnggggaatnccccaatacgcatntncggnaaatgtgncgggtcnaccgatagtcccaaaacctctggggccattgcaaaaaggggnccccangggncgntcttacaangnatttntnttttataccctnnntnggnggacannctgccagntctaatcnaancgggtgngattattngggggnngncacccttnngncncnnataatatatnnnggctccncatgtganggcncccnccatangnagtntatncncctcactataattatcntantcanncgcaacaantntatacnngtngtatacnttgaatnaagaatnccactnntatgctacgantatnnnnntngtcnnnnngntgntntnnnctnaantcnntnactacttctncntgnacnanntanntcgnacntncacnncctncnctanatntgntanttnanntcnnnnnctcnctngnnnntcntnacnngacntanntnnatngnnanntaananactnannntaannannncnnnnntntttcntnnttctacgnctncntancncnnacncnnnntcnntnnctanactctnttnnnannnnntantnnntcncnnaccnctgatntattncctcantatnnntnnttcntnntnnnnntnncgctnnaccatacnannacnacatnnnannnctgatntcncnntanntcctncnnccattcnncatgncntntnnntatcctctcanannaanatntntnnntganntacgntgtatgtctnnctcncgannataccncatcntnnctactagataccacnannnctntacnntnncacntntcnatatnnantatantctnctacntcancnanctctngntntatctgangacacatatntcnngatnacactgntccaantnaactcnagnnnnaccanggtcatcgacnctatncncncccc

SEQ ID NO: 5046 - DNA, 748 bp, Homo sapiens
  misc_feature (1)...(748): n = A,T,C or G
ncntntttcctctcnaatcgnttggtgttctttntgcaggatcccatcgattcgggtctacagtatgtagaagcagcaagttagtattaatgatgatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctacaactggttcctatgatgggtttgccagaatatggactaaagatggtaccttgctagcaccttagggcagcataaaggccctatattgcattaaaatggaatacgaaaggaaattcatnctaaatgctggattnacaa

SEQ ID NO: 5047 - DNA, 825 bp, Homo sapiens
  misc_feature (1)...(825): n = A,T,C or G
gnnnnnnnnnttttnaaagnccagctcttgttctttntgcaggatccctcgattcgaattcggcacgagcagaaaagttactgcagcttaaacaggaaaacccttcttgttcaggactgtcatagccacagtttgcaaaaagtgcagctattgattaatgcaatgtagtgtcaattagatgtacattcctggnggtcttttatctggtggtagctttgtctttttctttttcttttcattacatcagggtatattgccctggaaaattgngggtagtggtacccaggaaataaaaaaattaagggaatttttaacttttcaatatttgngtagttcaagttttctacattttaagtnccagaaacttttacaaaaatgccagtttcgaaaggtgtttccttgnggaagttnaccaagttaaaggaagatcattgggtaaattactatttttggnatggaaattttgctnaaagttnactggtaaaggaaacacctgctgactttgcaagtttaanggggaatctattcttcccattttccaaacccatggatatggaatggggcccctgaccatgtgggaagaggaattggataatttggggtggtttgcnatggggtggttttagatnaattgggattggggtattttaaaattaaccatttggnggaanttnaataggcctttnaagaatanccnttnaaaatggnaaaaaaaaatcttcnaaaaatttccaaaaaaaaaannnnnaaaaaacctcnanggnccttttaaaacttnttnnggaagtccnnatttacctnnnaatncccgaccntggatnaaga

SEQ ID NO: 5048 - DNA, 707 bp, Homo sapiens; identical to SEQ ID NO: 5010
  misc_feature (1)...(707): n = A,T,C or G

SEQ ID NO: 5049 - DNA, 762 bp, Homo sapiens
  misc_feature (1)...(762): n = A,T,C or G
ngnttttaaatcagctctngtcttttgcaggatccctcgattcgaattcggcacgagagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccancaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccganagcatgcccttctggcttacacactgggtgtgaaacaactaattgtcggtgttaacaaaatggattccactgagccaccctacagccagaagagatatgaaggaaattgttaaaggaagtcagcacttacattaagaaaattgggcttcaaccccgacacagtancatttgngccaatttctgggtggaatggtgacacatgctggagccaagtgctaacattgccttggttcaanggatggaaagtccccntaaggatggca

SEQ ID NO: 5050 - DNA, 761 bp, Homo sapiens
  misc_feature (1)...(761): n = A,T,C or G
tgcttgctcttgttctttatgcaggatcctanctcccnntccnggnaggagganacagttactgactntcccgcagacgtggtgctctttgaagggatcctggggcagaatgaggtggactatnnccagaagcaggtggtcatcctgagccangatagcttctaccgtgtccttacctncnagcataaggcctaagccctgaanggccngnncaactntnaccacccngatnnctntgncnatgaactnnttctnantncactnanagnaatnactgatngnanagnngtgcngatnccngtgtatgactatgnctcncattnccagnangtnccgatanctntccctgatganacnnnttgagganacagatncggacacccgggtctnacgcaaantattaanggacatcagcganagatgcagggatcgttgaacactataacatcgtcacttcattanatnncntcaagcntgcctttananganttctcctntgncaacaacagatncctggcttntanaggatcntnncatngaggttcncaatagatactnngtnggacaaacancctnatntgtgcaattnnattccntngaccatccntttaatgggaaagggncnttnnaaacggggnaaacccaattngttgncctaaaaggggnataaaacccnttttnaaacnaggnntgtangnncttcanaacttgnnannaattatggcccccattttaaccctttaatggcttttngtcccccg

SEQ ID NO: 5051 - DNA, 847 bp, Homo sapiens
  misc_feature (1)...(847): n = A,T,C or G
nngtctatagctggctctcgctnttgtgctgatcncatgancccatnnannnnantnngncccgntgaggnctntnatttgcaccatgttcgagtnanggtcctttcctaaacatgntntaaaaatatanatncgatggcttatttaaaatgtccctatgcatggngaaatgntaaataccangtggatgantggttctnnnntatattgtgaatggagaattatncacaatgcatctatatgtgtanactaataatgtanaatatgctcncttntnctgntctgtgnanaatgtgctctaaaatnccctgntngtgggtagcatgggctggacagnnattgattttcagaaaaatgcttggcttttgggttnttggcaatagggaagcctgcngcaaattatctcatttgncaaanaaaanttattttnancctatttgaatgtatgctatcttcantacgcttccatcttatgatnnaaggnntntcnnatttctantccaagacttcgngcntanactgtcncagtngggcatttgatgncttgtcaccagtggaaacctgaacggaaaggggctnnaggaccnaccttattccttaaggcccctggagaaaaacccgttnanttgggctccttagaactngctngcnggggaaacctggaaaacccttgcccctngtttttaaagggggngnnccttgggtttcccattngggngnctttaaanaaattttgggggccccnaccnaaaatttggccccggggattncnnctanntnggctngcccttttaantccttaanttaaaaaggncccttacaattttgggcanttggggggnnaaaa

SEQ ID NO: 5052 - DNA, 747 bp, Homo sapiens
  misc_feature (1)...(747): n = A,T,C or G
agagnnnnnnnttttnnctaatggctggggatagtctggnctttttncaggtngccnancgantcgaattnngcacgaggcttggatctttgtcnaaaccggttatgtatgtcaaggaggagtttaaggcctttccgcaccaccttgtgtatccctngcctgcncagcgcatgtatnacgtggagttgctccttaccacaccttanntgcccctgagccctatttnctagatttcttngtgggctggaaacccccgtnctccaccagcatntccattatcccaaactttctagncctgctgatcctancannaacggggtggaaactggagggcngcgttctggcngttgtcnaagaaacttatganttctattatnagtacaangangntaaaatggnnccaatattntttactaanctcatgntatatngagangaaactcctatgatctgnttcangaaggtggttatngctnggcngttnacgggntnnttanggntaccaaatntaactctgctntcataccttaatctgactantcnagnattnttagatgtttggggnganncatcctcttaaaatnggnaccagggcntggcttcngnngangcngtgntnaccaagtgaactatatgngntctcatcanntgctntangccnactggaaacacntttgncccgcaagnnnngctgttgagtcgatgtactgcnttcccattnatggctacanttgcttatnaggtngc

SEQ ID NO: 5053 - DNA, 1014 bp, Homo sapiens
  misc_feature (1)...(1014): n = A,T,C or G
gnnnnnnctgnnnntttaatcagnctcttgntctttngnagganccctcgattcnaattcggcacgaggnnntgntccttntgnncnncccnngntggnganatcnanntggcttgtcttnnnncgnacgcnngaagnaacgggcntctcacgcgcntntgnattgtntgacanggancatgnacctncntacnnnngccatntgntnntccaactgcntgaanggctaatcctnggcctgctctcnnannggntgnntgtggnaaanggngtttggtttaaaanncatannaatnnccttccatnattcagnctgtnttttnacngggnanttnatnntcaatncntntagctgntnancnncggcanngctcaattaatncntgnactctnnattttccctnccnttgnanttgcnatcacattaatgcggatcaanatnggnttttatgaggaanttntctcgacttattaaggnacccccaaccntgngctagtgatttttcaannncatgnttgcangaaaaaaaccctttcaaaaaccttaatggnaantttctttgaggcttaaanaataaaatncctggggggtttacttggggggnccaagcggggggggantnnaanntttngccttctttnttttgggaaccttttnanccnttgggaaatggaatgggaccctccccccnttttttaggggtaaatcccaaanggggccnttgnnngcggnccccnnaaaangtggggganatcnaaccctggcttngggggattttaaaaaaattttttnccaaaaaattnggnnntntttttttttcnnnnncnnnnnaatggggggaaattttttttttggggcccnaaaatttaaaccccggtttttttctccagggggnaaaaaaaaaaaccttttttttttttcccnnnnnnnaaaaaatgggggtnttaacccaaaaaanncccggtngnnnnccttttnaaancnccaaaaancntttttttcccccgnanggg

SEQ ID NO: 5054 - DNA, 762 bp, Homo sapiens
  misc_feature (1)...(762): n = A,T,C or G
agagnnnnnnnnnttnttnnctacttaattgcttggctacttgttctttttgcaggatcccatcgattcgaattcggcacgaggcattncctgctnggaacctngtntactaatttccactgcttttaaggccctgcactgaaaangcaagctcaggcgcnggtggtcgttgtgacccaacctgcagtcggtccnggnccggccccccagaactncaactggcaaacaggcatgtgtgactgnttnanngactgcggagtctgtctctntggnacattttgtttcccgtgccttggntgncaagtngcnnctnatatgantgaatgctgnctgngnngaacaagcgnngnantgaggactctntacaggacccgatatggcatccctggatctatttgngatgactatatggcaactctntgctgtnctcattgtactctttgccaaatcaaganagatatcatcaganggagagccatgcgtactttctaaaaactgatggtgaaaagctcttaccgaagcaacaaaattcagntgacacctcttnanttgagntcttcacnatcttttgcnactgaaatatgatggatntgcttaagtacaactgatggcatgaaaaaantcaaantttttgatctatnatnagatggaatggttgtnccttgactttagcttaaatgggngcaactttaggtttcttcttgctntcatattatccgaaatttcctggcttatnaacttttttnaaattaccatttgcaa

SEQ ID NO: 5055 - DNA, 1024 bp, Homo sapiens
  misc_feature (1)...(1024): n = A,T,C or G
ntnnnnangnancnctttgaaacgcctctctngtangcggatcccatcgattcggtntgcananggcacnaggctgctgggcctggaagnccttttggggccactcgctaattctcatgtgtngctccggcccctccagctgcaggtgggtgtggagtttgaggccagcacaaggatgcnggacaccancgtctccttcgggtaccagctggacctgcccaanccaacctgcttttcaaaggtaaaggtctnggtttccctacgcgggaaacaggcaggaagtgactcaacttntgantgggatgtntgggccaccacaggtgctggaggacagngagcntgncacccttntngggcctccacattacccggggaacacttgttaaaangtaatgtggggccgggtgccggtnngctcacgccctgtaatcccagcactttttgggaaggccaangcgggcccnaaggtaatgggagaattgnagacccatnnctgggtttaaacaccnggtggaaaacttccgttnttttaactnaaaaaattncnatnnnaccnanaaatttaaaccccnggatagttgggttttccngggttgccctaaattgggtnnccaaaaccttacntgnnngggntttnnaagggnncgggnaaaaaaaatngggtnnattgaaaanccnccangtaaaaggctngggaaaccttttggctcggagtaaaaaccccnaanaaaancccgtggcncanancccnggaaaattttcnnnaanccccctggggggcccgaaccnntntnnnnccaaanngaacttntccaatttttttaaaaaaangnnnanannannacnnataaaaangctcttggggtnggggacaaaaaaccccctnttttnacctantggggnnntaattggcctttggggngaaanaaaaannanaanantnttnnntataaaaaaantcgggccctaaacncctttgagggntgagatttnaaaacccccttngtttaattatcccccgcct

SEQ ID NO: 5056 - DNA, 822 bp, Homo sapiens
  misc_feature (1)...(822): n = A,T,C or G
tnnnntnaaacnnnannnnntnnnntcctgaannanancntaannncanananacnannnnatnaaangncttcnaanctggaaancttcnncgctcnagnagnaagacggggaaccagngnctnacgagcnagacaggtnccaattaggacntcatctggncnnctgtcagncatcaatgaggggcncaatgactatagcttggancacagaccacacacnncngcgangntgcncggctngaagnattatncacanctgcgnccccaanggggcnaggtgatggagnataccaccatccttnggntgcncgaggnggaatttgccagnnangggaaatntcagngtgtcatctccaatcactttggttcatcctactctgtcaaagccaagcttacngtaaatagnnggggattaaangannnctttggcattttaagattccnaggggccaanaaaangnanaaacnnntcnctcggnaatgttancccngnaggntntnatgngagntanccacctgnctcnttctttaccnacctnannnnncacagaatnaagatacttgggtatctgtatntaaacctgcnattatgggtgaanacgacaccgnactcaattgtggatgagtaacacaacanatgaaccanacntgtanntgctcanttttngacccnttntcnnttatnannnagctgaggncggcaatcttnnnantggttnccccaaaaggnttggaatgannatcccnggggttnncaantngannnttgnaatatngnagcnnaaatngnannttcaancnnntngggagnaaaaaancg

SEQ ID NO: 5057 - DNA, 1103 bp, Homo sapiens
  misc_feature (1)...(1103): n = A,T,C or G
cggggaaaaactcctncaaaaaaancagannnacctnannnnaggaggancccttaaaaaaatatggaggcccnttgngggggaccccccccaaaaaccanccaagaaanaantaaggggggncccttggggggggggatgaaaataanggggggnnccntnnnggnggnannnanncnnnnnnnncnnnnannannanannnannncncnnnnnnnanaaannnnnncnnnnnnnnnncnnnnnnnnnnnnnnnnncnnnnnnnnnnnnnnnnnnnnnnnnncnnnnnnancnnnnnnncnnnnnnnnnnnncnnnnnnnnnanngcnnnnnnnnnnnnnnnnnnnnnnnnnnnnnnnnnnnnnnnnnnnnnncnnnnnnnnnnnnnannnncncncaannnnnanncnncnnnnnnccnnnncnccncnnnncnncnnnnnnncnnnnnncnnaccancanacannnnncnncnnnncnnnnncnnnnnncncnncaaccnncncncnnccnnnncnnnnnncnacnncannnnnnaccncannnaccccancncnnncnncnnccnccnccccnaccnncnnncncncnnccnnnnnnnncnnnnnannancancccnncccaannncnnccnncnnncncccnncncnnccccnnnnncnccccnncncnnnnccncncncncnncncacnnccnncacccaanccncnnncnacannancccnnccccncanccnnccnncnnancccaccnccnntcnnccncncanannaacccnnannnnnncnnacnannnnnnnnccncnnncannnanccnncncncncnacnanncnccnnnncncnnnnannncaancnnnncnatnnncnncnanannncnnnccnnccnacncnncnnnnnccnncnncncannannnnannannncnccncnanannnnnnanncnnnnnancnnncancnnnncnncnnnnnnccncnnnccncancnnnacncncccnnnccnnnnnnncannncnnncnnnnnnncnnnncacnncncncnccnnncanccnccnccncncnnncnnnnnncacnnnnccnnnnancnncncct

SEQ ID NO: 5058 - DNA, 761 bp, Homo sapiens
  misc_feature (1)...(761): n = A,T,C or G
agagnnnnnnnnttntnnctactaatggcttggctacttgttctttntgcaggacccatcgattcgaattcggcacgagggnaaattgngcatnnnnntgtttgcngatggcnncnttanctattnnattaangcncnttatactctgctgcttaactngcttgtaattgcacntnngttacctgcacattttcatatngaatattgtgntancatngcttantgtgngtctggatggaagatncntgggcctacaggatcattaatgacatattgtttatattacagtattatatctgtgncatcagcngtaantncatttntttacaaatanangcctgttccatttgaaanatatacaagtgtgtggncaaaaggaagtatacccagnancaagcccatgangagtttcagcaagtgttcattcctgantgcnatgactacngcgcctacagtcangtncagtgtcacagctacacgggatactgntggtgcgtcacgcccaacgggaggcccatcagcggcnctgccntgncccacaagacgccccggtgcccggnttccntnaatnaaaagttnccccaacgcgaaggnacatgaaaaacagatgatgccgtancttcanngtnnganactcanccttaaggngattaagaaaattttgcatnaagtttacccttacccttttggaattgaacanggttaaaaagttcccaataacnaaaacccaataaganttcaatggcctcctntgganccaa

SEQ ID NO: 5059 - DNA, 746 bp, Homo sapiens
  misc_feature (1)...(746): n = A,T,C or G
gngnngnnnnnnnnngnnnnnnnnnnnngnnagnnnnnnngaggnntttnngatacagctcttgttctttttgcaggacccatcgattcgatcantgtgaactcttaaancatgcngaagcnnctctaggaagtgngaatctgatacaagctgtgatgttgcctganggagangatctcaatgaatggattgctgtgaacactgtgggatntcttnaccagatcaacatgttatatggaactattcagaattntgcctgaancaagcttgtacagtcatgtctgcanggnccagatatgaatatcactgncanatggtactaatattaaaaagccaatcaaatgttctgcaccaanatacattgactnttnatgacttgggttcaagatcagcttgatgatgaaactctttttccttctaagattggtgnccatttgccnaaactttatgtctgtgngcananactattctaaagcgtctgntcagggttgatgcccatntttatcaccagcactttgantctgtgatgcanctgcaataggaggcccacctcancacctgctttaagcactttattgtctttgntcaggagtttaatctgggtgataggcgtgaactggcaccttgttcaagaattaatanagaancttggatcacaanacngattaatgtttnttntagaacacagttccccattgcttaatctattgntagactatctnattgctatctggtattngactacg

SEQ ID NO: 5060 - DNA, 808 bp, Homo sapiens
  misc_feature (1)...(808): n = A,T,C or G
agagnnttnnncnnctgaagccctntaaannggctgggtaggtcgtnctntctccangcagccannngcgnntcgaattcggcacgcaggtagcgacntttnnagtangtggtgggcanctcaccgtgggnacagttagcctntctatncctngcntnctncaactccncgnantngctaaanggctggcnanaaagcatgnaaaggactccgnaaaggccannacataacgcngtatncnccgattcgcanancagctcggntggcagtgnccactnggantcgtnntatgatcgacacctagagatgatactggcgcacncagcnttngtncaacgcnggctcaacttggcnacnantgncacnggngcaggngnncctggagtacntnnccgnaagcngtgctnngactnggcntggactgnntcanaagactnntangtaaaccgtatctccacncgnatcntgcaactatgctncccttgganatgagnnancagantgtcatanaaangntacaantgcngatagtggnncantcacananatgcacagngcccntnttgncaanatnggacatcccaggaantgccagangatcanggangcnttgaaatnttangactnntaantgtcncncgcttgtnacagagctgnttgaaaggcagtcggantgcatccctggngaaagcccacaagtnntgacgttttggggattngnatttgaancaaaagcngaagaactttaattaggattctncnanccatcccnaattgctgggaattcgaaatctttaaccacatggcc

SEQ ID NO: 5061 - DNA, 792 bp, Homo sapiens
  misc_feature (1)...(792): n = A,T,C or G
taannatcagctcttgttcnttgaagcctgctatnnncagctacttgttctttttgcaggacccatcgattcgaattcggcacgagtggaaaangttttatttntncactgnngttgncggttaataanatggtgncaaacgtgcnctggtnacacactcgantatntntttangaaatgntnatgtgggnatgattaccnttagatcaatactttaaataattttacccnttttacaagggtaaccangggcatactgaaactttagaacncttncngcaatnncnatgggggangttgggtgangcttnggatccctcttttnngttttgcacgntgnaanngangttnccagntggcatnttgaatatgctgctttccaaaaacccangaagttntaaaattgcttcctggncttagaggactaanaacaagaccctcattcccactttcatttncactctagcaaaaactgggcttgcgtanttctccanctactcgnntatatcctcnttccatgtncaaaccttncattcctaagngggattggcttactttngcccatccatatggcagnatntntaatagctttgnaccggtattagatcttggccttaggcccangttcaaaacaagtgccnatctatgaccagggnccaaanaaaaaanatccaggatttcgaangaganacnntncattgggantnaagactcntacnaagtccttagccnttttcataaaagcctgggcctctaatgnctgnnaccattttaangggacanttatnaaan

SEQ ID NO: 5062 - DNA, 780 bp, Homo sapiens
  misc_feature (1)...(780): n = A,T,C or G
tttnaaanccntggttnaatncctnnttgaancctttttatgatacagctcttgttctttttgcaggatcccannnncaggcttgacccaccgcgcccagcctgtaatttcttatacttngtatnttgtacttgtattatgcttctgatacgctataatnatttatgtacatgtttttttnctncaatanactgggaactcttcgaatgtaggactnntaatgctagatactcaattattttntattaaattgaatgactngaaactacagatccttnatntaaacttcccaaatttatgctgtatttaancngctcttnaaatctggtcnntaangngaattntnaaggcttgggacatgcacatgatggntgtattgccaactgngaaaaggtgatggnttactggagcaggggcaaggacacctggccccgcccggagcaaaaactgntcaaccacaaacgatagcaggaaaaggcctgtgncttnngcaacantgtnttgctgcagataatnncncagagcctgnttctctgntcttnctgagattgctttggttccataaangattgttttagctaatctacaatctatagaagcaatgntanaacttggttttttggantaaanngnnggggnaaagnttngnaatgtgggntgtcaanntttngaaaaaannctnnatacnancaaaanttnanccattttnaatntttagnggnggantantttnatnnannnttnntaganactntgntgagtttgnaaaaacccaaantn

SEQ ID NO: 5063 - DNA, 762 bp, Homo sapiens
  misc_feature (1)...(762): n = A,T,C or G
cgnnnctttttgaacccatttctcgttctgcaggatcnnatcnattcgaattcggcacgagggaacttacccatggggactaatntggaaaaggtctgtccatagtggntccctgaagactggaattacttcagcaaaacttncccatgaacagctaatgtgtanngaaagantganctagcaaatgagttttaccggggacaaaaaatcaagcanaanagtgaatgcttagaaccttctcaaagcantcacaagtacagacacttcacttagcctagggggccttccagggttcttgtggctgntgtcagagcaggagctgggggagggaagacttgttctctctttcttgaggggtggcattaggaacttacgaaaccanagacctttccctatgacttggcagnatgtgaatatcctctacacttagttattgataaacttcttaaagagatctgctattttcaggtagtgccataatctgcacttancattggcttgcttcagttgggcctcttcccanccagtatgcccaggtgaactttcgaggttgtcattaagtaagttgtgaaatttctgnaataacaaaggcagtcnngnattctttccttttccnccaaattcctaaggcaaaacttttttatggngctggtnacatggggagtnacacaaccnnctgactttttctcattgccattgtaatgactgatgganaaccccaccncctgggatccaaatgacaattgtgctgaaaaaccnatc

SEQ ID NO: 5064 - DNA, 763 bp, Homo sapiens
  misc_feature (1)...(763): n = A,T,C or G
gnnntttnnnatctgctacttgttctttttgcaggatcccatcgattcgaattcggcacganggtgactgcagttgacgaaagcatgccatggggtatggggacattgntgggccacattttggngacngaccccngctgttgactttgggacccnatcctttganntttggcntgccctcntagngcttggaattccctgttttccagcccanccccnatggtatgtatattcnttacaagtnctccnaaagancanntgtctaggatgcggggaggggaggttccttccntangggagcgtgganagaagggagcagccttggggttgnattntnggtnatgcntcanattgggcatgcatgggatggnanangggctcagccactntcctncagaatcttcctnagaccctncaactgcantatgtaatnctactctgtncttcatanaaggganggagccacatatgacattccagttctaagcccancatggangaacangnctatgtccccatangtgangtanaagtagagggcttcacctgncagtatncctgccgctacttcctcacataaggaangacgaagaagnaaccnggacctcgctttnccatggtgcantcaggaacanggttttacgcagctggccaactntgaggctntgctgncttttnctgtggncagtccaggaaatgcttacaccaccttttttcccactnttncctcttggattntgggggncccncaaaccggaattnn

SEQ ID NO: 5065 - DNA, 762 bp, Homo sapiens; identical to SEQ ID NO: 5063
  misc_feature (1)...(762): n = A,T,C or G

SEQ ID NO: 5066 - DNA, 746 bp, Homo sapiens
  misc_feature (1)...(746): n = A,T,C or G
agagnnnnnntnttgtctactaatagntgggttggntnnttnttctncacgcannccagcgnntcgaattcggcacgaggtccatctttgtagctgacatgacacattttaaaaatttcacattaaaatgaaggcatctaatggctccattatgtcttttagagtggtctggcccagctaattgcatattgaaatacattagatttgtcataaattactttcctttattgtcttttctgtcaatcttaggacattaaatgtatatgtttgaaattgtgtttaggtaggttatctgagcatttggttcanatagtaaagagagtgttataagttcactgtaagccccaggggctttgggactgatagggtttagaacattgcactaggggaaatgaattgtaaagtaatgttntttctctagactaatgattcagctgaattaatacttttaatgtgaagcatttttaaagaaagcaaaccagcctggtgcggtggctcacacctgtaatcccagcactttgggaggcagangcgggccggatcacgaggtcaagagattgagaccatcctggccaacatggtgaaaccctgtctctactaaaaatacaaaaattagctgggcataatggtcntgcctgtagtcccactacttgggangcanangcaggagaattgcttgnacccggganatggaagttgcatgacccaaatcgggccctgnacttttacctgcacanantgagant

SEQ ID NO: 5067 - DNA, 732 bp, Homo sapiens
  misc_feature (1)...(732): n = A,T,C or G
gnnagnnnnnnngngnnntttnagatacaggctacttgttctttttgcaggatcccatcgattcgcaagcattcaagaaataatggtgagaatagcctgctaatagcattattccatatgcaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaagtttctccatttcttcttgcattatctggtaatagtagggaactagtattggattgaatgaataagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacaagtctgtctgaacctgccagtgctgaccctgcagcactttcagcatatgcacatcaaaagttggagaccgcgcctgaacttanganggccttcacacagactgatgtggctacccttctcagaattaacaggggatgtcaatcctttgcatttgaatgaanactttgcaaaacacaccaagtttgggaaatncaattggncatgggaagttttgacaacggact

SEQ ID NO: 5068 - DNA, 820 bp, Homo sapiens
  misc_feature (1)...(820): n = A,T,C or G
gggntttatatatcagctcttgttcttttgcaggatccttcnatcggtanncngnncganctganttcgtacnnagngctgctnntacctgggctnactggannnctccanctacncaggcagnaggatggnagctnaactnccangangagcttgcagagnncctgnnatccgtgccactgcactccagcctggcctnacancanccgngactcnngnctnntaancctaaaagnctcnttatcagcatgcntcccattganagngtcctacatnctgngacattcacctatattccngggncctnttaattnncaacnactgctcttagangtcttagncttttatgttaattctnataaatncnattgaatanatattatncccaaatcttagtgttngcatnttagctattnaancctntccaangtangttaaaggccaccgttttcngatnaatnctncnttttatantcnatctggaatancgcatttctntgagaataaaaganagtttntttnaanaataggatcttttngncccttcggnncgncctttntgncccntagctgctttggngcaantntgaagttgagngatcnncnttgtagccctaggaatttccananttgcnctgntgtnantggaacttctnanccttgtgccnanagnantnatnncccctntnntttttaaaaannaattngtttcaaanttcgnccttntttnaataggcttnanatgnttatanaccnnggncnaagttntncaatcttnantccctttnagnntccnaatnaatntaaantccttnaatng

SEQ ID NO: 5069 - DNA, 833 bp, Homo sapiens
  misc_feature (1)...(833): n = A,T,C or G
nnnnnnnatnatnnnnntntnnnntntntnnnannnntntttnnnntnttttggtgaggtnaatcttctnttancctccanntntcgntctnnttgcantnccngtcgattcngataactagtcaataaggaacaggatcaacggccactccacccatggcaaatccacatgcagggnntctncaccaaggttccagcctncaaagtgaaanacgccntggaacagcnagggaggtnaacaataattnaanananagaanggaataacggcnnaagaaaangaaaanagaancgaaanaactaangntngaaaaccacccggaaaactcaaggaatcacaatcctaanaagcccaaaaagggacaggangctnancttgangctggtggggaggaantccctgaggccaatggctctncatggaanangagcnagaataagaancanngcaaggacancnccncttaggaatangcacgcgttggcgcngggaaaacgaancngangcactctgaantttaaacatattctnagaaacaacaanatnaagcttccagaacattctgaagggcnganaaccagaataccatnaagctcctgcaaaaagttaattnnnctggaagggaactattaaancattctnaaacaagccccaaacaatnaaataaccctcaaaaagctaangaaaaaagtttttncttantactacacaggtgaccagatttagccttnaccagatttccaaanaaggaaactnccttgggtcattcttttaacaatgaaaaatttatctacntaaancctttcctttttaantttttttaaaaagggng

SEQ ID NO: 5070 - DNA, 741 bp, Homo sapiens
  misc_feature (1)...(741): n = A,T,C or G
agagnnnnnnnnntttgtcttntggctcttaanaggcttggctacttgttctttttgcaggatcccatcgcttcgaattcggcacgaggagccctcttattgtatatactgaacgcatttttaaattgaagagatactattctgtgtatctttgcaggcgaatgagtcctaggttggccagtgtctcactagttgagattaaatttttgcttatacttgttgatttgactgccttctgaatagtattaggaacacattgtaaatttgttgttgatggctggctgaagttttccagcacatttcttgaggttgccaagttcttctacaatgactgaatctactcttcattcattctagtcagcagtctcacacttaattccaaggtttacttaagatttttttctgaaaaagcaatgcttgctttccatatttgcatattttttctctgccttaatagcagaaacaatggcttcatcttgcatttgtatcagattctttccattgatatatcttgtccttattagctagttgtttcccactgggtgcagtggcttatgcctgtaatcccagcactttgggaggtcaaagcgggaggattgcttgagcctaggaattcaagaccagtctgggcaaaatagtgagaccccatctgtcaaaatgaaaaaaaaaaaaaaaaactcgacctntaaactatagtgagtcgattacgtagatccagacatgataagatncatggtgagt

SEQ ID NO: 5071 - DNA, 760 bp, Homo sapiens
  misc_feature (1)...(760): n = A,T,C or G
ntttttnaaaacnacangctncttgtgcangatcccatcgattcgaattcggcacgagggtggctcggnctgtngctgnggtttcctgagttgctgctgctgcggcggcggcagcggcgtctgtgcttgnggaggtgtcggcctntgggcggatgttgacattgtgttgntgttatngctgatggtaatggcnncggcggnggcngctgacggtccagaccccatccactctgtagccggagccganacagccgacagcgaactncncggcctcgnatccggcagcagnggngactnccctcagcctgcgccgcctnncccgncggtncccnngagccaacccngggagtcangncctntnngcatgggagctcgnaagctnangatggnngatttacacaaaanctatgatgaataggaggacnaggancggccctggaggagcagctgctcaattactcaacggacccggtggtcgtcctcggatccggtcanntcancgtatnaggactgagcaacaaatttgaatctgaattgcctanttcattaactggaaaantcactcctgaagaatttaaagccngcattaacattantnacaagttggattaanaaaaaccttctgtaaatgtccgttnctncttagnggangccttnnattgctgctgccattangtncnntttgtggccagtnnttggctnaattaaagaacnctaaaangttgagnatttantagaatgggaaaanccatccgttnnt

SEQ ID NO: 5072 - DNA, 742 bp, Homo sapiens
  misc_feature (1)...(742): n = A,T,C or G
gntttactnatatcagctcttgttctttttgcaggatcccatcgattcgaattcggcacgaggaccgccaattctaagattgtagtggtaactgcaggagtccgtcagcaagaaggggagagtcggctcaatctggtgcagagaaatgttaatgtcttcaaattcattattcctcanatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcnactcaagtgtggctgtgtggagtggtgtnaatgtggcaggtgtttntctccangaattgaatccagaaatgggaactgacaatgatagngaaaattgnaaggaagtgcataagatggtggttgaaagtgcctatgaagtcatcaagctaaaaggatataccaactgggctattggattaagtgtggctgatcttattgaatccatgttgaaaaatctatncaaggattcatncctgtcaacnatggtaaaaggggatgtctggcattgacaatgaanntttctgagccttncatgtatnctcatgcccnggnattaacctcgtnttnacccnaacctanggatgataggtt

SEQ ID NO: 5073 - DNA, 732 bp, Homo sapiens
  misc_feature (1)...(732): n = A,T,C or G
gnnngnnnnnnnngnggnnttttatatctactggctacttgttctttttgcaggatcccatcgattcgaattcggcacgaggcccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttncatgttcagtaagagtgaattttcagtgaaaagaagattcacgactttcttggtttgccagcaaaattagcagccaatatttacatgttggttatattggngccaccacttccagaaaagagtttagtagggatgacccagggc

SEQ ID NO: 5074 - DNA, 772 bp, Homo sapiens; identical to SEQ ID NO: 4969
  misc_feature (1)...(772): n = A,T,C or G

SEQ ID NO: 5075 - DNA, 750 bp, Homo sapiens
  misc_feature (1)...(750): n = A,T,C or G
agagnnnnnntnnntcttatcgcctaatgcttggctacttgttctttttgcaggatcccatcgattcgctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtttttgtttacttttactccatgggcattgaaaaggttaagaaacataaatggtccatatttttaaagttaagtagcatgcatatatatatgcacacacacctctttttcagcattttttgagaaagtcttggggtctcaaacacatttgtctcaacacatttccaaatgtggattctaatagctcantgtggctgaaaaagtgccna

SEQ ID NO: 5076 - DNA, 761 bp, Homo sapiens
  misc_feature (1)...(761): n = A,T,C or G
agngnnnnnnnttntctnnnctactanctgnttggntgttgtttctgcangcaggcnntcgattctaattctgccgnacncgngagtaaagctggaaaatnacctataaataatggcanaaaaaaagctaacaatanggaagaggaactatataaaaggaacatttggagcatagaagagagttcatggaaatgtnaaaaatgatggtaccctgggtttgatatagtaagtaaaaaactaagggtaagagggtcatgaaagcatctagaagtaggagggaaagccagtcaaattcacaggatgaagtcaggaagataatngagcagtgcccgcaagatcctgagggaaagcaagttccaatctataagtctgtaaccctcacacctgatggccccttgaacatattcagggcttcaaaagattgatctgtcatgcaccgtctgccatgatactgtgtgaggatgtgttcttcttcttaaacattaaatcaagaaagaatcaacagtggacccagttaatagcngatcagccnaggataagatgccctagaagatggtgaagggaaagtctcagaactactggtcttcagcaggcagcgaagacacctgatccatattggantggtggggatgcgaacttcaggaagggatgcccccaaggaaaaattggnaagggntgatgactgncttcaanaggttccaggtcttttaaaaattttccctnccaaccntcacntttggctttngaaanccncgcctgat

SEQ ID NO: 5077 - DNA, 765 bp, Homo sapiens
  misc_feature (1)...(765): n = A,T,C or G
agngnnnnnttttntctctcgcctaatgcttggctacttgttctttttgcaggatcccatcgattcgaattcggcacgaggacnanccctngcgcctgcctntccangatgtctacanaattggtggtattggtactgttcctgttggccgagtggagactggtgttctcaaacccnntatggtggtacctttgctccantcaacgtttcaacggangtaaaatctgtacnaaatgcaccatgaactttgagtgaagctcttcctggngactatgtggnctncaatgtcaagaatgtgnctgnnaangatgtcccgnccaaggcaacgttgctggtgaccgcataaatgncccaccaatggaancatctggcttcactgttcangagattatnctgaaccatncatgccaaataagntnccgntnatnnccctgtnttggattgccacacngtttacantgcatgcaagtttgntganctgnaggaaatgattgacnncnntctgnntanaagntagccnatggccctanattcttggactctggtnatgctgncatngctgatatggttcctgncaagcccatgactgtcgaanagcttctcaagacnatncaacctttggntcnctttcgtgctacgaggatattgngcaccggacagttgccgnaggcnttttgatcaagggcccntggacaaaaaagctggtcgaacctggcnaaggtnaaccaanncttccccctaaaacttcannaaggnnaantgcan

SEQ ID NO: 5078 - DNA, 969 bp, Homo sapiens
  misc_feature (1)...(969): n = A,T,C or G
annnnnnnnnnnnngncnncnnncnnnnncnnnnnnnnncnncnnncnnnnccnngnnnncnanncnannggggnnnnccgntnaaaaccggtngcccnngcgcncgggcggggnggcncnnanccgaatncngcacgnacggggccgncggngggaccctgggntgggggcnagaancanccgacgcnggccagaanagggggnctggngncccaaganagaanncatgantagnacactgganacnaaanccgtgtggggacacatgaanccccnancccatgngtcgnancctgcccanaagtgantgtgnagntnactggaagttggggntccaaccgncaaaccgtgggatcccaaaacnncangncaagccaggaccttngcacagcccgnaaaggnanatncccnctnaanngtctngagacccgggntgnctgggggaaacagcaggcccgcacantgnnnggngtngggacttancggaaacatgggtaacgtngcancagcgccacgggagtccaacccctgaaaatacccaganctcgcgtgnananccaaccgngnncccaaaacaaagcnaggggntatgggnttaaaanccccnnanttnaanagcccnccgnggggnaannangnagnntttttgggancccaaaancccnnggagggggcccagganncgaaaaaangnatncccnttnaaaaggncnccangaactnanaaaggganaaccannntncgnngcccaatntnacccccaanncaaatncccnnttccgtgcngncccaatnatccnccnagtnccattntggccncnagnggngggggnncnncaaangncttcttgnaaacanatnggggaaaccntttnaccaaaaaanngcgnannnggggcccaatanccaccgggncccccccananncannggccannancntgggcctccaaaaaaaagaaanngg

SEQ ID NO: 5079 - DNA, 748 bp, Homo sapiens
  misc_feature (1)...(748): n = A,T,C or G
agagnnnnnntttttgtctctaatggctggctacttgttctttntgcaggatcccatgcgattcgaatgcngcncgaggcnttagttgctnnttgaaaagggaactgcacntgatcnnatcatggaangatagctncactncttnccgaccttggtcacaggccgncatgagganggactgttccantgctncngnggccnctgncntgntnctcatcactggncttagctttggagtacncaactccaagtggcccgagtctagactctatcaaatnccacactgatagcaacaatgantgcatctgatgtgtgctgctggcnatcttaagcccaaaatgcttcaaagatnaaacagncatatacattnaagatacatatanaaatngtnnaattngaatgtatacaanntagattaccctaacgaacttcactacaagaaatncatcttatatccnngcacnnaaatgtgganntntacatgaaaggatataccgtttnanaaaccacatnccatntctaaatgctgantgagaaggcntggactactaaacctggattactgatnaaatttcaaaangancttgattttgctagcagaaatcnttacccngttctcnagcttctataancagttcttgaagggattanacagctggtcctctntccaaattctggattaatttcagctgtgtatttccnannnaatctttcagcctctagaactatatgagtcggnttacgtann

SEQ ID NO: 5080 - DNA, 949 bp, Homo sapiens
  misc_feature (1)...(949): n = A,T,C or G
gncntactttnttatcntancactctgctttncgtcatcatcgantcctatnatgtgggttnacctnatgcgggnntaanccagnaacancntggcccatgtnnccntgaactcacattntgttcatgnattccagaattnttnantgganagattaatagncagaaaccccactaggnacanatcacnanacngacgcttntagcttgnagacctnttaggcanaaagtannaannanantnggatcttgcngnccttaatctcttccnggaanangggcctatagntggcnacttggaaaacacggcnctgntccanngtttnntgccccnnacccgagacaccacnagtgtcacctccaaggggggncttcaaannttggggtgcgcccggtacctnttgaaaatgaaggtcncccccaaatggggngngagttnnccatncctcgccccttgngggttnatttgggngaacctcnttggncccctntttttacttttagggggcancccccattttcncctttgggacccccttnggattttgtcnccttgggaaaacaatttttcggggnccaaaactttanaattnaannttggtttanagcnaanantgtggncccaaaatgggtacangggggttnccccaacaaaagccggctctttttgatattgcatacctcaatncccacttgtcaatccntttttaattactttancctctaacataatgaatnttancgccctnanaattccntcctganatacatgtgangcctnttgcctganaaantgacacgaatnatttttnaanngatctnntgannnncnctcancatacgatattntacntctngncttnagaanactcttttattncctggnagatnaaaanggtancantntaangctntnttgtcatcctcanagganttaangctataaaann

SEQ ID NO: 5081 - DNA, 779 bp, Homo sapiens
  misc_feature (1)...(779): n = A,T,C or G
ngnttnaacacctgntgtcgttctgcaggatgnangancnctngnttcgaangngcnangngtgcatgatnctgnccnnnnattgctagcgntaanacccncgagggagtatggatncctgnaaagcnctctggtccttgggaanccnntccttnngtgcntnttattactgnaattnntcanaagattntgagatgctcncagtgtcncattgctactntnattgtaatcattatgggattgatacgctgtcanaantactgccagcggcagctggagttgcttngcatttcacagtacanacagnagactatgtnaataatnggcagaanaattctactnngctgtggaattcccaaactaatatggnccagaaactagctaatcnaatcanttatgtccaacaaactgtaatgnggctaggagattgagncgttagtctagaatatagaatgcagntacaatgtgattggaatacttctgattnttgcattactcctcatctgtataatgaaagacagcatgagtgggaaagagttaagaaacatntgaaaggncatactggaaatttactttagatattntgcaactgaaggaacaantttttcaatctttctttggcacatctggacacttaatgccaggaactgaagttgcttggaaggcgcttcaaaatgggattaagcaactattnaccccattaaaaatggatcaagaccannaaactanaanaaaaactcgaacctnttaaaaccattantgangtcggantaccttan

SEQ ID NO: 5082 - DNA, 935 bp, Homo sapiens
  misc_feature (1)...(935): n = A,T,C or G
atgggnatggnnnnnnnnnnnnnnnnntttttttgtttaaaaacccctttnaaaaattgggnaccctttnnggggtntaaattanaatccctnttgaggnncttnntacnctccctcnaanaanttaanacactantatggccgtntttttcccnccntacctttgntntacacccccattgtgcnaaaagntnncgcaannggtnncgaccaaacnttgacannctctatagtaantttacnacncnacttgnncacttcgccanctcttnaacgccanactagtagcagaagtactccacccttnaanaaaacanacaactaangcccttttactgccctcatcatccnnttangnacctgcttacctatgaatgcctnttanacatacanatntaatacctggaaaatcatccacccngcccncatattcaaacnanacaacacatccnnacactaganactcttgcccccacatcctcaggtncnacaaaacanaaaaggnttnctncncatanttcttactggccntncctgaactangnaccgcatncaaaccacntcatcncttantannttcncttgctccttagccagcttctgncctganaaccnccaanctggaaaaacacatctnccnanatccattncttgngatcacaaanacnntnnnccgcgnnctcaannncctactcaaagatccactgtcncatctgnccccctanacccctttncntangcattcctaactttntanacaaactgctttacncttagtncanggaactnctaccttgcatcatcncccntttttncntnactttcttcctttgatccttacncttcaaagggccttnngaancnttgacccnanaatnaaatttaattccccnttnttggaggngtccttcnaaaccnantttntaaacaccccn

SEQ ID NO: 5083 - DNA, 752 bp, Homo sapiens
  misc_feature (1)...(752): n = A,T,C or G
ggnnttnaanntcagctcttgttctttntgcaggatccctcgattcgaattcggcacgaggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaatttcttggtgaaaaaggaagaattgacccttgaaaggaatcaaacagttttatattaatgttgagagagaaggaatggaagttgggatacacttttgtgacttgtacgagacacttgaccattacacaggctggnatttttctcaatacnangccncaagggtggacctggcttgactgagaagatgcacgccnngagactttacaggttcttgcttntggcttcgcgggaat

SEQ ID NO: 5084 - DNA, 728 bp, Homo sapiens
  misc_feature (1)...(728): n = A,T,C or G
gnngnnnnnnnnnnnnnnngnnnnnnnnnngnnngttttttaganacagctcttgttctttttgcaggatcccatcgattcgcnctacncaagngntnagccnactncncntcaannnnanactgggcanggatnagactcatannaacattgtgctgcattgagcaccncagattcagggagccatcaccactacatggcanattgtgatctataaattgctggggcatnatcacatggntccattntcnnaatggncaaggatgcttgcacctatcgancngggctatgttnagtatncctggtcattggctaaactcatagctnancgtaancggantataaccattgacctatgctngtggacatttgacaccatcagtgtacttatnngantgatcactgatgcctcatgacacngacctttatcaaaggacatgatggccaggncctcttgangcntaccgtgctatcccngaatgttgctnctnctntnggggaattttcaacctgaggntntgaaataatggncaaactcaccancatggcttganggcntacacactggntgtnaaacaactaattgactgngatacagaaggntncnntgncnacttctgnaggatagatctnagaattnttnagctgtaggctacntnagaaatcggtacaccctccatcganaggccatgatgtcnatngtacacaactnaccatnncttcatgta

SEQ ID NO: 5085 - DNA, 870 bp, Homo sapiens
  misc_feature (1)...(870): n = A,T,C or G
gagaagngnantnncgganagnnnnagtnngccagttccaaaccnggaaacgccntcgcnaagnnggngggnnggnacnngnaaggcgcanccggnncaccnanccgnggncccnaggaccaggnccgcacccnncangcgncnantggaccccaaggagctcnanngcngcnnacancnannaccgggnncacannggtagcaagaagaggggancgncaagcagnngaaagcagcnggcgaacancaanccgangnannannanacaggaacacccganaaggaagcggacctatanccnangcccacaaganaaagacaccangnnccatgcttaccanagggaggcaagcnnaatngacanccnacngcanngaacctgnacacgcggatggacacccngcgcgngnngngaatagacggacggacagncaactangcccaaaangcanngccaanggnngnnccgccaacngggnacagtgaacaagngcnattgnggnngngcnggannacaccancatcnnaanggcannagnaagcaccgncnagnncnggacannanagccctgcnangngancnccnaaccangaacanannanggnacnangaannnancaaccnnnnnggggaanaaaacccanccacgangaacaanngnacccnggaccgtnggcccananaaaacgngncncnaaggncacgantcncanancgngggcccnnnacnaagcncnccatcnanangngnnaagctccgnggcgagcananngganacnacacccacgnnnngacacggaaaaccaccgncagaaaccnnacgngancncccanangnggncancnaancaanagngcccncncccc

SEQ ID NO: 5086 - DNA, 870 bp, Homo sapiens; identical to SEQ ID NO: 5085
  misc_feature (1)...(870): n = A,T,C or G

SEQ ID NO: 5087 - DNA, 759 bp, Homo sapiens
  misc_feature (1)...(759): n = A,T,C or G
agagnnntnnntntttgaatcctaatggctggctacttgttctttntncaggatcccatgcgattcgaattcggcacgcaggggcgncccatcttgtggntcantnnctatgcctnctcccntgaccacccgacagacgtggactacanggtcatgntcacngntancgaattctacaccangctgatnggctttgacaanntccnnctntancagttgtncaaatccactatnncngcnaactcgagggtcangccnaacngtaacnatggccagtgagggnacctacgcaactgnactccganngttgtatggagaaactggtagacntcaaagactgcctntccgcttngtggtnccngcnacagaggangangtcctacgtgnntgagggtncnnccnttggggttatnnnancgnantaggnntancnctggacnganctggaggcgcatgacancacatgatgctttntgagggcctgaagatnatcntgancnacangtgtccngtgangccctgtgantncattatcatgtagatttaggtngangaatgncctgggacanatgtttgtacatagnggccacctatganttnacagantatctcataactnatcagattgcttnacngtctgggnancnaactcactcattggnaanntcttgcatgctatncccaatgggtggatngccttnancttaaanataangntgntttttatcaanngggcananaaaccgtnntannngggtn

SEQ ID NO: 5088 - DNA, 738 bp, Homo sapiens
  misc_feature (1)...(738): n = A,T,C or G
gaattgctctgtgtttttgcaggatccatcgattcggnagtgngnagaggcnccacacntntgngataaatgcactnnannnctncngccttgaanttcnnnaggggtcannnctnctactcacnggnaggngngccnnaagananctgtgggtnctgntggatnaannngtnattgacngccctggnctggntcaaaacncnnccctagtcntcangctncagggtnaggnacanacngaatntacntctcctntgngaggnatcntactattncgtnatggnnancntaatgctccacannaangtgcngtngactcacgctgctacgactctcgagacnnttcntagaagatcattgtcntctntaccncnntnggaacttnaactatgtattgananaaccttgaggatgctatgtggccacagattccntattcaatggaaaacgnccnnctacattatgcangggnnnctttctgaatcgtgtngcacntcnttcatggggctcnaatnngccgcttnaancncaaatattgggcgcttgcacngctttgacantgtgtaanntctnngtntgcnangctatacttggacccatttgccctgtatgngcccttngcaatggnttcntttcnaagtataactacnancttncaaatggncaaggtcctgatnnntnccattttgcnaacgtgctcatttnaanactgactgnaancgtttttgacaaaanaat

SEQ ID NO: 5089 - DNA, 856 bp, Homo sapiens
  misc_feature (1)...(856): n = A,T,C or G
gngnagnnnnnnnnnnngnnnngnnnnnnnnnngnnngtttntnatancangctcttgttctttttgcagggatcccatcgattcgaantcanctcgancatggannncctcncctcagcantcnnatgngcnncctnggcnagntcacnnttgctgcttnagnnnttnctgtcnntncnaattntgnaangncttnaatgtgnnannaatcaggaaaatgctncntncaannctttagnnttnnaaccntccatattcttaacatntgngacatnccatgggatgcnattaatattcaaggnttttatncggtactnaaaaatanacacttctaccngtcaangttcngaaanancgatcatncgcntgaancatngnatgtnnatancaacctntgaanagntnctcatttncacctgaaatcatggcactnatagcaacctttntanaaggctataaaaanggacttgaatgtncnaattgcccaagaagagcgctacccttcgggaaggggaancctgaatgttgcaaccactggggataataantacccttattgtcaagaaaatggcattggggggcacattcatntgaatttnggacctggngactccttaccgaaattcccanccaggttccacnaatggnaatttgaagncccgtttgnctnttcgnggaccagtggggaaaagcaattaaaaggccaaaatccttccnaaacctttntcaagggttttnagnaaagtncccacatggtttnnnaaaggctttaaggacttgcnnttgggaaangggnaaaaaccntttaaattgtaaggcccaanggattccggaataccgccngtacaataaaaa

SEQ ID NO: 5090 - DNA, 721 bp, Homo sapiens
  misc_feature (1)...(721): n = A,T,C or G
ggntttnnatcagctcttgttctttttgcaggatcccatcgattngaattcggcacgagagaaaatcagggatgtattaggaaagtaacagtctctcatcaagaagccctggctcaggnatatgaatatcagtactgtggagaggccctatggatgccatgaatgtggaaaaacttttggtcgacgcttttccctggtgttacaccagaggactcatactggacagaaaccatatgcatgtaaggaatgtggcaaaacctttagccagattncaaaccttgtgaaacaccaaatgatncatactggaaaganaccccatgagtgtgacgactgcattcagacnttcagttncctttcatggnttantgaacnccnantaacgcncactgnggngaanccttangnatgtactgagtgnggaaaggcctttanccgagcctacaacctcactnggcntcaganaanncacatntgagggaaacactatntatgtanganatgnggnnnnncntttannactggctnagaactcnntngccncnanattacacatactgaagnnanaccttnnngatncatngnatgtgngaaaggcattntgccgtttcttgcaccttactccnangtcatancntncctacaactcaaaaccccntnttgaatggtgcngaatntagagaaagncttttcgnnggaatctcnttncttntnnaaannattc

SEQ ID NO: 5091 - DNA, 760 bp, Homo sapiens
  misc_feature (1)...(760): n = A,T,C or G
gagnntttnnccncnngaaagcccttctgaaatngcttgggnaggtcgnnctnncncncangcagcnanangcgntggcgaattcngcacgcaggcaanactttttcctggggcaggggngtcagcnattattnaattggattattnctaagttngctanntgggncanntgtgnngagnagggagnntncctgccacntnttctgntncccnncttctgcccacacatgcagcatccaaagtccattnantnaatgaatggacanagtgccgagcanacnggggcnnaancangnncncagtcnacgcatccngnntcntaggnaaagtggtgaccgntcncggngggacntgccnaanccctgnnacacagncggncacnntnnanggacnngcanncctnggatgtgcctcaggaaaaacagggcnagccttcnagnnccgnatacgagtnncnggccttananncnanaacaanggcnctnacttgcngcatgcttcactattctttnaggcacatatatnttntcttattagntcctcncatcccatgagggacncagtggctnatgcctgggaaancngnccttnngnangtcaaagngggaggattgctcnacctaggaanncaagaccacgctgggcgnnatantgngaacccancggtacgacttgaagaaaaatatcctaancncngccttactaactttagngngcncaattacgtaaganccanacggatcagtttcaaatnagggnn

SEQ ID NO: 5092 - DNA, 766 bp, Homo sapiens
  misc_feature (1)...(766): n = A,T,C or G
nnnnnnnnttnnnnnnnnnntnnttttnannnnnnnttttnaataattgctattgttctttttgcaggatcccatcgattcgaattcggcacgagcccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgttccccagccacaagcgcaggagggagacacctagccctcggccatgagacaccgntcctccaggtcttcataaattgtctttgggggattccaccacacccaatgctctggagccacaaggagtgtnccttnttcccacagaccgtggganggtccttgctgctttctttgaacttggcagccttggatgganggctcctttncctccctttttttttttttgt

SEQ ID NO: 5093 - DNA, 851 bp, Homo sapiens
  misc_feature (1)...(851): n = A,T,C or G
gagaagannnnnnnnnagaaagnnnnnnnnnaggnaggttctaaatncttggctatcganctctnagcaggagcccatcgattcgaattcggcacgaggcgggcgctaggcgcgcgcacccagcactnggtcccagncgananatctggggcagcgcgcggtggaagctgcgngcngannggancanttctggctcacgaccttgacgctagcgcgnntatcangnggaaaccncgnnnccacnnnaacaaaaagntggctggatgtggtgncncncatacctggaatcccagcnnctntagcggcnnaagcatcagaatcacntgaacccanaacacaggncgcnctganccaagattgtgcccctgcattctagcctgggtgacagtganacnggctcaaaaagataaaggtgtacagggantgtatattcagacaacntggtatggaagatgtgctacnnctantgnnccangctgatactaagtnaacactcnntacnatanaganggagatntgggacncataggactgnggncatnttaattanttcangantgttttccacnagcnnttaactggatttcacattanagaaacntttncaaggaccctnnaacgggtaaattnccaacggannnctccaaatgtaccaattttantgccccgaatngggaaaattncnacangnccctttnncanggtatgnacanagnacttttaantnacccnccantcaacctnnnaccanttnntttantccangncannctaccagttgtncnaccacaaagntttnnaagncccattnnnnttngtnaatnnnngggnnaaacccnnnnacaaattcn

SEQ ID NO: 5094 - DNA, 731 bp, Homo sapiens
  misc_feature (1)...(731): n = A,T,C or G
ctcttgttctttttgcaggatcccatcgattcgaattcggcacgagattggattgccacacggctcacattgcatgcaagtttgctgagctgaaggaaaagattgatcgccgttctggtaaaaggctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaaagttattagtttttaaaatcagtctttttaatggaaacaacttgaccaaaaatttgtcacagaattttgagacccattaaaaaagttaaatgagaaaaaaaannnnnnnnnnnnaaaaaaaactcagcctntaaaactntnnngaggcnttttcctanatcccacntgataaganct

SEQ ID NO: 5095 - DNA, 755 bp, Homo sapiens
  misc_feature (1)...(755): n = A,T,C or G
gnntttnnnnnnnnnnnttttaagnaatttgcnactcgttctttttgcagggatcccatcgattcgaattcggcacgaggattacatagtgacatatattagcttttcgtccacatttgataacattgctaatattttcttttttttttactgaactctttgaatttaaagttttctctcatttaaatttattaattaaaaacatacctttactctgttccctttagcatttcaacctgatgttaaaagatgtgtatgtgtgatatgtgtgtttgaaattttaactttcatcttggagtatttaattctctgaagcagtgcatgactcttgctcttcagcctcttgagagtgtccctggtttatattcctgatgatacaaaccctggaatttcttgtctgaagtgtnaacactttatttccaggtcctaatttgatttgaatagtggaagttcagattcaatgcattaatgacagattctatgttgcttcttcagatttgccagacagaaaaacctacttatgtgaggaaatcattaggctttttgactatcctctttgtataatgagactcttttctcattagatgagtaaaaagatccagagatgatcaccagtatcccccagaattcatatatatttaattgaaaagaaacaaatnctgggattctttnctaaaaanggtggattacatttcttgnctgnntgnacatctttgnntaacgngaagaaaaataaaaatattnattttccaccc

SEQ ID NO: 5096 - DNA, 777 bp, Homo sapiens
  misc_feature (1)...(777): n = A,T,C or G
gnnnnnnnnctttnaaatcgcttggcnttttgcaggatccctcgattcgaattcggcacgagagcggnntttntnntgnntgccnctcatttgtngnannnantngacttnatatntnngatgatnnannnangtangntatgagnnatncacatnnnattnangntgnannatattcnaaggnannanntncncagacnntggntggnnacntntcanatngtttagactnngncaaaggnnangtnacaacggatnngaccncacctanactgagannacctggancctcagnatcnatcnggnaatcgctcacnnagtatacttncancagnanntntaaccttagatactcgatcttaaacttgnntatccantntaaaaacngtcntttcngacggntgtntnncatcaancagnnnatctnnaaatctgnncanaggancgnttttaaactcatnnctggaatcctcagatnnaggacccatncangnaggnntgancntgnntgccctgtnagcacgnanttccanntgngtnaactctcacaatgngtttnaagaacncnaaaggctggcccntgntcntatgagtgattctccctncttatctngggngncncnattnaatctttggaaaccnaannttcnntaatggttncccactggttnggaaccaattngaactgcaccttccngtncctttantngnggcaaaccaaancatncnttancattccatttgaccctnnttttttacnttaanacnanccttgac

SEQ ID NO: 5097 - DNA, 761 bp, Homo sapiens
  misc_feature (1)...(761): n = A,T,C or G
aggnntnnntttgnnnctaatggctggctacttgttctttttgcaggacccatcgattcgantgangctcnagcaggccncatgagatcncctgctnggnncnttgnnntctnatggccactgntatcnnagccntgnnctgaaggtgcangctcacgcgncggaggtccnttgagacccagnctgcttcnatancagtccggtcnctcananctcccactggtanacnnncatgtagncactgntgcagctgactgcngnancnncntntgtggncacantaagattcgccgngccttgcntgannanntactnntnatatcnatgantgctgnctgannagaactngcnnntcnatgnggactgtcttcagnaccctatatggcntccntggntctgttnccgnngacnatttngcgacngtnaatgtgccncattgtgctctnatgccattcnatactagattccacagaaggagaccntgcgatntgcttaaatantgctgntgaanagctnntaccgaatcnnnanagttcataaaacgcctcctnaggcagantctgtnatcntcngtagcatcccnaatangatcgatatgctaacntacaactgatgncctgngantaatcaanntcttnatttantatcaatgaaatgctgctcctggaacttaacctggaatggtgcagctncaagcttngtcgncgcttcncancttggtncccgatttccnggccacttannccntttgaaanttccct

SEQ ID NO: 5098 - DNA, 761 bp, Homo sapiens; identical to SEQ ID NO: 5097
  misc_feature (1)...(761): n = A,T,C or G

SEQ ID NO: 5099 - DNA, 781 bp, Homo sapiens
  misc_feature (1)...(781): n = A,T,C or G
gngntgnnnnnttnnnngnnagnnnnnnnnngnnngctttttagatcagctcttgttctttttgcaggatcccatcgattcgaattcggcacgaggaaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctanggtcactagtggattatgaaaatgctaataagcactggataaagcangagcanaaaatcaagatgttctacaggccgaacttcccaacaattatgttgtcagaaatttgaaaaaatatctgagtctgcaaaacaagaacttatagattttaagacaagaagagttgctgcattcagaaaaaattagtggaactggcagagttagaactgaagcatgcaaagggtaatctacagttgctgcagaactgcctggcagtgttaaatggagacacattaagccacacttccgnctttctggttaaaaanggctggcctttccttcaaattttatttttggntttcttaaatggatggttaagccttttatgcctcactgggaaaccaaaccaaaaagccacttggaaaaaggtgccntnaacttcctcttttttctggaaga

SEQ ID NO: 5100 - DNA, 797 bp, Homo sapiens
  misc_feature (1)...(797): n = A,T,C or G
ttacnatnantgtgcttganggcttggnccnaaananattggctntggcgaattcggcacgaggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtanagaacatctctgcactcaagacagtttacanaaatnaatgttttttttgctttttcaaaaacaaaaanntcntaaaaaacctcgagcccttttanaacntattantgagtccgtatttaccttanaatccagaccctgattangatccatttgntnaagnnttgct

SEQ ID NO: 5101 - DNA, 752 bp, Homo sapiens
  misc_feature (1)...(752): n = A,T,C or G
gnnnttnaanngctggctcttgttctttttgcaggatcccatcgattcgcgaaggggaagaacagatcctctgaaatttcaaatngaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgnttaactgaacagcaaatgaaagaagctcagaagtggaatcagccatggcttgaatttgatatgatgagggaatatgatcttcaaaaattgaagctgcaatatggaaggaaattgaaaccgtcaaaaangtcttgattcttgagaatgaatttgggtagttgcagaagatccattggctcttaagangatatattttgaganccat

SEQ ID NO: 5102 - DNA, 742 bp, Homo sapiens
  misc_feature (1)...(742): n = A,T,C or G
agagnnnnnnttttatctctaatgctggctacttgttctttttgcangatcccatcgattcgaattcggcacgaggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgaccagatcgggagaaaggatttcatctggatgtagaagattatctctcaggagttctaattcttgccagtgaactgtcgaggctgtctgtcaacagcgtgactgctggagactactcccgacccttcacatctncaccttcatcaatgagctggattccnggtttcgccttctcaactgnaaaatgactccctgaggaaccgctacgacngattgaaattgacn

SEQ ID NO: 5103 - DNA, 1245 bp, Homo sapiens
  misc_feature (1)...(1245): n = A,T,C or G
gcntncctttgcatacctaanagctggtngttctttttgcaggatcccatcgattcgctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgnannngcangcccnannnatcntntgcntntccctcnctccnctcttnntttattcantccttnnccctctnncatttnnatnnntnnactcccttnnactcnttcnnccantctntatctccncatnntccttctctcctanntannntcacnctcnanctctcttntacttncnatcacnntcaccttctcntctctanncctcatcncactcntntnnnccnatccnctcnccccttnaccnnntnacttanacctcccnatctctnnatnttcanctntntatctacactctctntccntctcatctacanntnnatatcncnnccatnanacactcctntctctcacnctcncncannttcactcttactnntactnntnnnctnanactacncacacttntctattnctctnctnnactctnctatnctactctcctnctcttatcntcctctcncnncattnctacttctcatctccactntcncanctncctcntcttcntctntancctctccncntancattcttctttcattnnnacnccntcatcnnttanccnctatctnttctnctntccnctctnnccncccncactctcnccatcnccnnncnctntcnacannntctctcctcccntacctccacnnnctctcccncctctcatatactcttctcanatatctcttnnnatncntcacctcncacnanacntcaatncnncttaccttannccntnnanccatnctnaccctctctactcttnnacntattctcncattctnccttcacttatctntattntctctntntcnccntantctcncnctttctcatctccctnnctcacatcactctacntnctct

SEQ ID NO: 5104 - DNA, 1701 bp, Homo sapiens
  misc_feature (1)...(1701): n = A,T,C or G
cnggnnaccttctaattgttcttcntggcggncttnaaaaattgngcttgtngggccncctttaaacnncntgaaattatggcggnctttgggggggatganattatgnngtnctnttggggggctnannttnatggtctcccntnnnnnactcnatgntctntcctaanatntcnnntgntnctcctttcgcngcnttatctnntgtcantntcntnntcncctcttnnctcatccantntnttacatctcctctgncgangcnctcannnannncncgcnncnnnacatatacctntctttcnncctcatnnacntatacnnntctcnctcnccatanacctctttnnanctactcntnttatccnctctcctactctctccgtcncnngttcncanntatcatatacccncctgctatcgtccctcttcanncttctgcnaccctctctnacctntctccctnccntngcctanttcatcatnctatcccntctnncatcccatcnacanttctaccactcccancacccccttcctantctccntcctntcnaatctnnnnntttnatatctnantcncntctccncctatcntctttctcctntcnctntnccaccnccccnctnatntcncnttcnncctnnntcngtntccnacccccttnatccctacacacctctnncnnnacntctcgnntttcctctntcntctntaacatccactncanctatctttnatctannctctanctcanccncctnnccatactatccatanccanantnnttcaanntctccnaccnctcctcnncactctnttatctctctnngnnctctncncntctctntcactctanattcttatactntttcntactacctntccnctctatnactnnnctactcacnnntnctnatctctctctcctcntanactcnctcactccttatanatcttcnatnctatcacactannctncncctntcntactnatatcttnntnttntctctcacactntacatcactncgcantcatcnntctcctcantacnnccnncncctctctacatatatattccntctctctcctcntncntctctntctcctctntctntcatnanacancactnactctncatctntctctctatnnntntccntcactcacattctntncacnnccanttnccnctcnccgtatctctanntctcnacntctctctactnctntntctcncatcccactctatnatacntcncncctatttnccntactctctctacatacnnctctctncttctccactctctctctctctctcnaanttncncctctnctnttnntcatntctccnctcaacctntatcnctcnanatcnnctannctagtctctctntanncattctcntatccnnnntcnatntcacacancnnataactntctncatcactcctcactctctntatnctctctctcntntatactctctctacntntcnntntcatccanacacattnttcatnctatatnntccncncnctctcctctctcttntcatacatctacncacctatcctntccactctctcntctcatnctcncncatctntctacnnatcnctctctnntancnatnctnnctctncacatatctcactctcactcatctntctnnctcncnccntctccct

SEQ ID NO: 5105 - DNA, 756 bp, Homo sapiens
  misc_feature (1)...(756): n = A,T,C or G
agagnnnnnnnnttnttctttgcttantggcttgggctcctngttctttntccaggnagcccatgcgattcgaattcggnacgaggtgtnaaagngaacttttaagggaggttcctgctgtnccagaaacccttcaagaaaaagcgaaggnntttctcagagctgaagatcaagcgcctgagaaanaagtttgcccaaaagatgcttctanaggctaggaggaagcttatctatgaaaaagcanancnctatcacaaggcatatnggcngatntacagaactgnaattcgaatggcgaggatggcaanaaaagctggcagctcntatgnacctgcanaaccnaanttggcgtttgtcatcagaatcagaggtatcaatgcgagtgagcccaaaggttcgaanggtgttgcagcttcttcgccttngtnaaatcttcaatggaacctttgnnnngctcaacatggcttntattaacatgctgangattgtagagccatatattgcatnggggtaccccaatctgaantcagtncntgaactaatctcaaacgtggnnatggcaaattcaatannaagccgaattgcttnnncagataacgctttgatngctcnatctcttggtcaatacggcatcatntgcatggangatntggttcatgaaaactatactggtgnnaaacgcttcaaagangccaattacttcctgtggnccctcaaattgnnttntccacnantgggaatgaagaaaangacccc

SEQ ID NO: 5106 - DNA, 748 bp, Homo sapiens; identical to SEQ ID NO: 5079
  misc_feature (1)...(748): n = A,T,C or G

SEQ ID NO: 5107 - DNA, 674 bp, Homo sapiens
  misc_feature (1)...(674): n = A,T,C or G
gttttctcctgttacatcatgctgaatcctttcccttagccattagcttttattatgtggtcttcataggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttccgtatctaaatataaagtantgttagaaacctgaaagtacagaatctcaaccttacnagtctttcccttagtcctgtggccttcctaagccagctgttaaccgtgttgattccttccacttcccccaaagtaaggcaggcaacagatatgttgattgtcttagaaagtaatctggttcctctgaactccattgaattccagtttgacgcatactgcctggaaccagactgtttgcttacagctttttaaagaaaaatctgncttggtcctgnccccant

SEQ ID NO: 5108 - DNA, 589 bp, Homo sapiens
  misc_feature (1)...(589): n = A,T,C or G
attgaggaagatctaggtaaaacctttaagttaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtakatcgggataattccaaatttgaggagtggtgtattgaaatggctgagatgcgtacaaagatgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttccattacgttgtactcctaaaatggggagctgttaatnaattataacctttagggtcagcactctgcatccctggagtattgttggtntttatatttt

SEQ ID NO: 5109 - DNA, 660 bp, Homo sapiens
  misc_feature (1)...(660): n = A,T,C or G
aagggaaggaggctgctgggtagcaaataagccccttcttttcttggtgagttgatgacctccaatagctcccagtgkcaygrgkacccagtacgcattagctggtgttgggttgattgagacctggggcagttcctggggcaagaasccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagncaccctgaggtttacccaggcaaatatattgattagcaggaaaaa

SEQ ID NO: 5110 - DNA, 615 bp, Homo sapiens
ccatagcctgttgagtgttcccagatgtgactcacctttctgctgccctcttcatgcaggcctactgactcataakkcacgwkgtcccaaaagccaccccacaagcctgagccaacctgctgcctgacgccacagtcattggcagaggtctgggcattattaatytataaaaatccatgctttacacctggacagtasacagggacttcagagattgcacgttkgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaat

SEQ ID NO: 5111 - DNA, 937 bp, Homo sapiens
gtggtggctcacgcctgtaatcccaaagtgcatggattacaggtgtgagtgagccaccgcggccggcctctatcattttctgactcagcagctccaccaaaattgacatcctagcaaacactgtgaaggaattaacctaagtsyttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagttttttttttttaaatcacktgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaaaaaaaaa

SEQ ID NO: 5112 - DNA, 653 bp, Homo sapiens
  misc_feature (1)...(653): n = A,T,C or G
gagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgmaaggtcatcgtcatyggcatgggaagggcattaattaccaaagtggagacasagtcactgtctccaagagcatttggaatcacttcacagagttctcaaggaggggaaggctatctgtcagctcctggcgggactgctgccccatatactgtgatgaattgcttcacatatctgagttctgatgggaaggagtccaagtgcggtagctgtagagaacgctggggaagcccagttctatgtagctcacgtatgaaaggaatattcatgaagagnaaaacagaggcattatttgagattaactgcctgagaaacctagtctaatcccaagtgtctagaaaatgttgactacttgccatgtgcccagtaaggtgcttggagctttatatgnatcctctcatttaaccctgtgacatagttatgctggtanaccttgctgcgttcgtgtacnttgaatgaagttgaagcttaanggaaggttaaaacnccaacccnaactga

SEQ ID NO: 5113 - DNA, 559 bp, Homo sapiens
  misc_feature (1)...(559): n = A,T,C or G
ggaagaggatgactgggtatgctgtgccacccttgagggccatgaatccactgtgtggagcttgggctttgacccgagtggccagcgcctggcgtcttgtagtgatgaccgtactgtgcgtatckrgcgtcagtawctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgctgtkttcaggaggatcccaactcggatccacagcagcccaccttctccctganagcccacttgcatcaggcccattcccaggatgtcaactgtgtggcctggaaccccaaggagccagggctactggcctcctgcagtgatgatggggaggtggccttctggaagtatcagcggcctgaaggcttcttgaagctnacctcgacttttggacagagtaatggactccccagaaaacgttcatataagaattttaccagncccttg

SEQ ID NO: 5114 - DNA, 554 bp, Homo sapiens
  misc_feature (1)...(554): n = A,T,C or G
gaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggccmwtagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaattcaatgttcacatgaacaaacaagctgcccccaggggtaccattttggggagggggaatctttttttttcttttcccctttaaaaaaaaacacntttgncccgaacattttcccattttnttttt

SEQ ID NO: 5115 - DNA, 477 bp, Homo sapiens
gctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttgccatggcagccaaacggaaggctgagaatccatctccacgaagtccgtcatcccagacacccaattccaggagacagagcggaaagacattgccaagcccgctgcagtctgcaaaggtcttcacaaatcagaatcaactggtaatt

SEQ ID NO: 5116 - DNA, 957 bp, Homo sapiens
  misc_feature (1)...(957): n = A,T,C or G
aatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtccgaaatgtctctagctcatataacttaatagtaataactaaaaaacttttagaatttacttttgaaaggagggaagccagttctgaaatgagtataggttgatttcatagtccncctaattaagagtttagctcnttggtaaactccaaatacataaactttttaagtggagttccatttactggaaggattaaaatgggtacagtgccagccatattcnccaaaaatattgtctaccggcntattttggtaanccgttaggttggggttttggttcc

SEQ ID NO: 5117 - DNA, 534 bp, Homo sapiens
  misc_feature (1)...(534): n = A,T,C or G
cttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgttcggcctctcctgttaaacaaaaacattctaaaagccattgttcttgcttcatggacaagaggcagccrgagagagtgccagggtgccctggtctgagctggcatccccatgtcttctgtgtccgagggcagcatggtttctcgtgcagtgctcagacacagcctgccctagtcctaccagctcacagcagcacctgctctccttggcagctntggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagcc

SEQ ID NO: 5118 - DNA, 300 bp, Homo sapiens
caytygkcaggggmsaggggacagcaaggtgggaggttgaagagctttgaggctcagcagcatgtttgtggcattcggtggacaccatggccttgggcggctggacaggtttttgtgatgtgarggacaygcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactc

SEQ ID NO: 5119 - DNA, 598 bp, Homo sapiens
tttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttgg

SEQ ID NO: 5120 - DNA, 1416 bp, Homo sapiens
  misc_feature (1)...(1416): n = A,T,C or G
agtgagtggtcttaccaaaaatccagtatccttgccatccttgccaaatcccactaaaccaaacaggcgttccttctgtgcccagtcctagtattcaaaggaaccctactgccagtgctgcaccattgggaacaacacttgctgtgcaggctgttccaacagcacactctattgtacaagccacaaggacttctttacccacagwgggcccatcaggactctatagtccatcaactaatcgaggtcctatacagatgaaaattccaatttctgcatttagtacttcgtctgctgcagaacagarcagmwataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccangctcaggctcccttgcgaggaactgttatgcaggctcctgctgttcggcaggtcaatccccaaaatagtnttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgscagcacatctytgcctcagaagccaccccacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatngttactctcacccagtttgtatctggtagcaaatactactttgcagtacgagccaaggatatttatggacgttttggtgctttctgtgatcctcagtcaacagatgtgatctcttctacccagagcagttaaacttgggagctttaaaatttcccctttaaaatttcacttttgggcctggttttaatctgtgcatgaa

SEQ ID NO: 5121 - DNA, 300 bp, Homo sapiens; identical to SEQ ID NO: 137

SEQ ID NO: 5122 - DNA, 300 bp, Homo sapiens; identical to SEQ ID NO: 162

SEQ ID NO: 5123 - DNA, 634 bp, Homo sapiens
caagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagcatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggaaaaaaaaaaa

SEQ ID NO: 5124 - DNA, 672 bp, Homo sapiens
ggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccamcatccccagtgaaactttaagaggagccrgtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaactaaa

SEQ ID NO: 5125 - DNA, 738 bp, Homo sapiens
catttgtaaagctgcagggaaagaggttccacttcccagcaaccccatcctaatggcttatggcagtatctcaccttcagcttatgtattagagatttttaaagggatcaagtcgagtgagctggaagaatctctacattgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaaytatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaacatttttcctttaaaggactcctaaactaagcacagaagagttggcgtcatcttaaaaataccaagtaacagaagatcgcattgcagatgatatcaggatgtggtttccagctttgcctgagggaattccaacatgagattatgggctggctccatttcttggacttaaaatgcattattagtttaaaaatctttctgtgctctcaaagc

SEQ ID NO: 5126 - DNA, 1203 bp, Homo sapiens
gcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatkggcacccgtgccctgcaggtgttgacaagatccgccatctgtaatgtccttggcacaataaaaccaaatgtcagtttccctgagccccgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactgg

SEQ ID NO: 5127 - DNA, 669 bp, Homo sapiens
aattactggaacccgggaggcggaggctgcacagtgagccaagattgcaccactgcactccaggctgggcaacagagtgtgactccgtctcaaaaaaacaaaaacaaaaasaacttckscctmckmsrcagactcctcccctggtcaccactagtgatccaccttatggatctcccaaggccacctctgcctctgctctgtgttgtattatttgggggacctgtggtctggcatgcattgtacttggtkscccaaagggctgtggcatctgataagtgatttatcctcaggcacagatttgcactatgtcacccacttacttgtatgtagaagtgagtcaccggctggcaaatgggcatagctgctgggcagtggatgcagctccatgcatgttattctcatttgatacaggatctcattggcttctcacagcaatcctgtgcactataggtattgctcccgggaacagatgaggaaacaggagagtgcgagattacagtaattttgtaaatgggaggatttgtgaaggtttcagacatacaccctctctcatatgtcaaggatatgaagtctaatgaatcccctaaagcagcaggggttggcaagcttgtgccctggggccaaatcagcctactgcctgtttttgtaaataaagttttattggaacac

SEQ ID NO: 5128 - DNA, 476 bp, Homo sapiens
  misc_feature (1)...(476): n = A,T,C or G
ggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggaggaggagttcctgcgcgtgtgccggctgaaggagaaggagctggaggccctgccgtgcctgtacgcsacggtggaacctgacatgtggggcagcgtagaggagctgctccgcgttntataaggacaagatcggtgagnagcagcgcaagaccatctnggtagacgaggaccagcttt

SEQ ID NO: 5129 - DNA, 340 bp, Homo sapiens
  misc_feature (1)...(340): n = A,T,C or G
aatcccacaaagcctagcaccaaacttctttttttcttcctttaattagatcataaataaatgatcctggggaaaaagcatctgtcaaataggaaacatcacaaaactgagcactcttctrtrcamwarcymkagactrktswcwmwcagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattatngaaanaatattttgtggtata

SEQ ID NO: 5130 - DNA, 610 bp, Homo sapiens
gttaacttctctgagagagttccttgtaaggctacttataaatagtagtatatatatatatagtttatggcagggaagatctgggaagtaagcaaaaagagcctttagttaggcaacatagaacaaaatagaggtcacaggttccatgcactgaagaatggaattgaaatagagactccagggtcatagactcttggaaggaagactagagtacattcatgaccctcacccttaattacttcacaggtgagaaaaccaagagctacagaaaataagttattcctcagywccagggcctrsytccttggagaattgggttaaaattcaaaataaccttctaaaaaattctttcagaaacgagtagtgaaagccagtggatcaaattcagtgatagttaacagagaaacagcagcatagataagtaagccaatttaatgtagggagcaaccactagtgtacatgatctcagctcatctggtactaccaagtaaaaatgaacctgggccagccacagtgactcatgcctgtactctcagcgctttgggaggccaaggtgggaggattgtttgaggccaggaatttgagaccatcctggtcaacatagcaagac

SEQ ID NO: 5131 - DNA, 300 bp, Homo sapiens; identical to SEQ ID NO: 1013

SEQ ID NO: 5132 - DNA, 300 bp, Homo sapiens; identical to SEQ ID NO: 262

SEQ ID NO: 5133 - DNA, 757 bp, Homo sapiens
gctgccaccacccccgggcccagcctgtctgaaagttcagggtttaggccgagaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctygctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 5134 - DNA, 1316 bp, Homo sapiens
gtggcaacttgatgaaacagccaaatgcaccagggcaggtcactttcccattacactgattccacaattaaaaaaaaaaaaagaaaaaaaactcattgaratagctacagttctataggttaatttaaagcctcctttttctactcatttttgaaascaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgttttttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaaaaaaa

SEQ ID NO: 5135 - DNA, 377 bp, Homo sapiens
aacgcttcaattgttttgtagaaattttaataggaacttcaagaagtaaacctttataacattgtaaattcttacgtacagcatcacaaaagacaaggaatmctgtcatatccttttagcaaaatgakattgcctaggttcttgttgcaaaataccacataatgaaatccttcctgttgcatgattaactgggtgagaatatcatctttccttttggtccgtagaaatgtattattcactactccattcttgaggtttgttttttaatttttttggagacagtctcactctgttgcccagtctggagtgcagtggtgcggtctcagacgtctcactgcaacctctgtctcccaggctcaagtgattctcgtgcctca

SEQ ID NO: 5136 - DNA, 550 bp, Homo sapiens
  misc_feature (1)...(550): n = A,T,C or G
gaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgmagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaatagaatttatcaagcagaacattgtgatatccagtggatttgtgggaggctttttgctcggacctgcatcttaaggncatgaatattctcccataacggattcaactatgagaagagaagtggcagcaataaggcagtctctcaaaagtcatactgccagagtctctagggcaaggngaaacanctagctgggcaatactcaattcacaacttagcattttgccatcttgaagcttgg

SEQ ID NO: 5137 - DNA, 447 bp, Homo sapiens
  misc_feature (1)...(447): n = A,T,C or G
cgccagagcagcagtggggaacatcttcttgtctgctggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgytcctgggatacgctatgaactntgaccngctccccanccctccccaccaaggggttactgcaggggaagggctaggtgggggtccccgagatcttagggaatttttttagggggattttaagccagagntagtttgcgttcccagggaccaaggagaaagaagcat

SEQ ID NO: 5138 - DNA, 555 bp, Homo sapiens
  misc_feature (1)...(555): n = A,T,C or G
cgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccaggtgcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaagggggtgtgctgagttctataatataagctgccatatattttgtagacaagtatggctcctcccatatctccctcttccctaggagaggagtgtgaaagcaagggagcttngataagacaccccctcaaacccattccctctcca

SEQ ID NO: 5139 - DNA, 576 bp, Homo sapiens
gctacgtgggaggctgaggcrgragaatctctksmrcckmrgaggmrgaggttgcagtgagccaagattgtgccagcctgggcgacagggtgaggctcttgtctcaaaaaaaaaagtccacatcttcatgaaccctcagactctggagttgggtgtcggcttttttagccagcttttgtkssrwttrsykwkracctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttaaaa

SEQ ID NO: 5140 - DNA, 631 bp, Homo sapiens
agtacccagagttgcgaggagttttttaactgatttagccaggtggcaatcatgagtgaatggatgaagaaaggccccttagaatggcaagattacatttacaaagaggtccgagtgacagccmgtkmgragawtgagtataargsatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaawrtaaaaat

SEQ ID NO: 5141 - DNA, 300 bp, Homo sapiens; identical to SEQ ID NO: 315

SEQ ID NO: 5142 - DNA, 699 bp, Homo sapiens
gtttcactgtgcggtgcagtgcggcggcagctcgtgaggaggacccgtacatkgacaccaccctgaaggcttgcccacctgtcagtatggatgtctgtgctttaagaatacagcttttcataggcttgaaagccatctgtcactttaaaaaccacatcatacttttgactaaagcagaaccctgaagccattccagagagaagacagtcacccaagaggcttctttcgagwaarsatmccmktgyymmarkcaaaatwcctgccwgtwkctgagrmtgagktgkaaytkgtatattktgwrtaykatctywccagtgcagctgtacaaagagatggtagactatagcaatacctataagactgtcaaaacccagagctgcattcaccttctcagtgaggctcatctgttagtgcgagctgscctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaaatcttttacattaaatccattccactttatggaaaacctgggatgtaaggaatt

SEQ ID NO: 5143 - DNA, 423 bp, Homo sapiens
  misc_feature (1)...(423): n = A,T,C or G
caggtagtggcccctgtaagcagggccagagtcgggacaaagagcaggagtgaagcagccaagagacagaggaccaggctggagccagtgggcacgcaggagcctgcctgggaagaagccggggggcaaggctggcatgggaatgaacacctgctggtgacacctctctgagcttcagttcccttaactagaaaaatagaacaggcccggtgcggtggctcatacctgtaatcccagcactttagrkatgrytgmrrcrrktrswtcwtsagrtcaggmswtccwwraccayymwrrccgacattggggtattagcaatgttttgttacttgggcattttcaagaggcagacatagtccagaagcagaagnttgggcaggtcccagatcttgttctatagccctttatcctgaagctcgtgcc

SEQ ID NO: 5144 - DNA, 366 bp, Homo sapiens
  misc_feature (1)...(366): n = A,T,C or G
gctccttcttactctagtatctctgcctttggtcagtcagagagcatttgatgagtaccatgctgggctggaccccatcctggctgccctggaagatagagacaggtcaccttgatccctgcctgtagcatttgggctggctgagatggtggargtgtgaacagaatattccagtccagtgtcctctgtggtagggatggggatggacccsggagaggccctcctgttcctggcaggaggtgggactcagagttaaaagtgaggtcaagrcccagtgcgatggctcacamctgcagtcctagcacttcgcgganttnaggtggatcaccagaacccngtagttcaagaccagccttgganaaanat

SEQ ID NO: 5145 - DNA, 952 bp, Homo sapiens
ggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgccctacatggtgtcagatgtccttggtgtagctgtgccggctggccgctgaccaccaagccagactatgctgggcaccactccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagmctccttaaggagccacaggatggtacctggccccaaaaggaatcctggagaggaggacagtgacaacaggtgacttyattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaaaaaaaaaa

SEQ ID NO: 5146 - DNA, 431 bp, Homo sapiens
  misc_feature (1)...(431): n = A,T,C or G
gcaccagcaggtagtggcccctgtaagcagggccagagtcgggacaaagagcaggagtgaagcagccaagagacagaggaccaggctggagccagtgggcacgcaggagcctgcctgggaagaagccggggggcaaggctggcatgggaatgaacacctgctggtgacacctctctgagcttcagttcccttaactagaaaaatagaacaggcccggtgcggtggctcatacctgtaatcccagcactttagrkatgrytgmrrcrrktrswtcwtsagrtcaggmswtcmwkaccaccmtkraaaccgcattggggtattagcaatgttttgttacttgggcattttcaagaggcagacatagtccagaagcagaagnttgggcaggtcccagatcttgttctatagccctttatcctgaagctcgtgcc

SEQ ID NO: 5147 - DNA, 1101 bp, Homo sapiens
tgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttmaktckgmmykakkcctagttcaggcttactatctagaacctcatgctagcttaggttgcatgtttacattgctgcagtgtctttactggaagcttagttggatcgaaatggacaccgagatggagatgcttctggctacatttcgcagaaccccaggagacctgcatttagaccactctgtccatttgtgtgcccacccccacccccagggtctaagtgtagactccaagaggagcagcccagagcttggaggagaggtgtgtctggggsaccactggtgggtggtgctgctcttctttttgttgtagttaatgcggtgtcttttaatggactctcaggcctcccagacagccttgttcctttaaggcagaagctcttcttcattgtgtaccycctgggattcatgaggtgtgagatttggcctgcttgactttgaattcaagtttttcaagtgactctcagtgtcagaagaagatttcatgctgtccacatgtggtatgtccacagctcaccttcaaaggcttagatgtagccatcacagagagtggtattttattaagaacccaagtcccagcctgaccaacatggwgaaaccccatctctactaaaaatamaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttggggagctgcttcaactttggaatatatgtttgccaatctccttgttttctaatgaataaatgtttttatatactttt

SEQ ID NO: 5148 - DNA, 515 bp, Homo sapiens
  misc_feature (1)...(515): n = A,T,C or G
ggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggttcctcatcgacggcgtggagtgcagcgacgtcaagttcttccagctggccgcgcagtggttcctcgcacgtgaagcacttccccatctgcatcttcggacactccaaggccaccttctaggccccacccaccaggggggcccacctccttgccccattgntgtgagggggcccagcttgcattttcttgtttaaacattttcagttttaattacagaggacagacgtttnaaaacacaaag

SEQ ID NO: 5149 - DNA, 710 bp, Homo sapiens
  misc_feature (1)...(710): n = A,T,C or G
cagagctgtatcttcagtggtgtgatgaagctacagtaggggagatcactcatgctaggtatggatctccttacccttggcctctgaatcatattttggcctatcaaaaacagtgggaagkcaaacgtaagrtgraagctatkggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttaaaaaaaaaaan

SEQ ID NO: 5150 - DNA, 648 bp, Homo sapiens
  misc_feature (1)...(648): n = A,T,C or G
atttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaaggaactgtgctgcattaaaatccacagttgcatgaaacttttaaaagtttaagatataaagtaattgctaaaatttgtgaactactcagaggactcaatgccctaacatgtaggggattgatcattgcgatgtttaggccaggatttctcatgattgtatatggttattgatcatttttaaggggctgaacctgctgcctttatacttttgacacctccctccctcccncccwccaaactgtggctgtaaacagtgactctgcatagtcagcgttatacttgatttctttgtgaatgcaaataaaataaaatttgtaagtccaccaaatattgacttaactaggtaaatgt

SEQ ID NO: 5151 - DNA, 906 bp, Homo sapiens
gtactttgagtgtttgggggttcaacacacacatgcaattttgcttaacaaaagtattttataatacagtttcatacagaattaccttaaaagggagtcttatgttttcaactacagatagttgwaagggatcataccagaagatattgatgatagtkgaaatattcttagaaggggtgtgtatgtcctagcctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccrgagrggaaactataaagtaattacmcatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatgg

SEQ ID NO: 5152 - DNA, 677 bp, Homo sapiens
  misc_feature (1)...(677): n = A,T,C or G
caaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtagsctcccycaracscagccccaccatggtccttcggcctcagcagttccaattctaccagccacaggggatcccctcctccccctcasccgtggtggtggagatggggtccaagcctgccctcacgggggagcccgccctcacgtgcatcancaggggcagtgaggcccggttccactccgcggccagctccctcattatggaagacaaagaaatccccatcaagagtgagcctctgccaaaaccgcccgcatctgccccaccatccatcctggtgaaacagaaaactcaagaaatggcatcgaaagcaagtcaaaaccgtgagatttcagaattacagccctcctccaccaaacattacacctccatccacctccggaaagcctgacagcagcaccctcaaggcgtccagctgaagcagcgtcttgggccagagatgacatctatttgccaccgagtgctgcactcggcaagagaagactcgagaagtagctctgcaaggca

SEQ ID NO: 5153 - DNA, 301 bp, Homo sapiens
  misc_feature (1)...(301): n = A,T,C or G
ggcagtgctgcgcggggctcccagccctgctgggaaggaccagggaaccactcagcaattagaccctcttggccctgcccccaccatgcacccagcagccagggagtgcagcggkcagcctggcagtgagtgaaacccaggcctycagccctccaaagcctggggccaccccctgtagcaggcgatgctagaataaggaggagagccagagctgaggctccttgccccttggcccctycaggggccatgggatctctgtctcccacacccctgtcacggnccgcctggancancccatagg

SEQ ID NO: 5154 - DNA, 427 bp, Homo sapiens
gtgatccgcaagttgtggaagaaatacgccaagcaaataaagtagccaaagaagctgctaacagatggactgataacatattcgcaataaaatctygsgycramagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcwttttattaatgttaaataaagtgtaaaatgcagatgttcttcaccccttttggtagaacaaaagcaggatgataaccatatccccccagtgctcatcaaagtaggacactaaaaatccatccatctcagtcaaagtcgagc

SEQ ID NO: 5155 - DNA, 775 bp, Homo sapiens
cttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaa

SEQ ID NO: 5156 - DNA, 713 bp, Homo sapiens
gttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttatkcaaaracagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcgctttcacctcttgtaaaattgggctggcaacaatgacattgtcatgctttatgtccaatatcctcctgtcgagatctaatggtcttaatcgtgccgtaaatggaattcccccacca

SEQ ID NO: 5157 - DNA, 529 bp, Homo sapiens
  misc_feature (1)...(529): n = A,T,C or G
agcagctgcatctaggggcccttggtgagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaanaaggagggcaggatcccaccctacagggctggganggancccaaaggccccatctgtttctcctccaggagttgtcaaggcagcagaaaggantcacccagccaaaggaggagatggctcancggggctgcaccaaggggccaagaggcctnacccgtgtctaaaccctcctctcactcccctaagcctggtngaaaagagtcagaaan

SEQ ID NO: 5158 - DNA, 459 bp, Homo sapiens
  misc_feature (1)...(459): n = A,T,C or G
ttcatttttaaaaagcttctccttattatgttgttgtttaacaactkaaacgctatctctagaccaggaataattatttgctatatawtacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctgggyrtagtttaaaagactggaaaatattaagtgtgtggggaatgtagagcaactgaaaatggcctacatctttcataggaaatgttaaaaccaatacaawtactttggcaaaactctgtccmacmttttctacccmtttcacccagggcactyccttccctggcttttgggttnccccggg

SEQ ID NO: 5159 - DNA, 300 bp, Homo sapiens; identical to SEQ ID NO: 407

SEQ ID NO: 5160 - DNA, 540 bp, Homo sapiens
  misc_feature (1)...(540): n = A,T,C or G
gtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagcmwtaactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactgggcctgtgggtgatgcaaagctgctttgctctgtatctgggctgggacttgatctgtctcacaaggaaggccatgagggncatagggggaggaaggcttccttntcccccttcatctttctgnttccaaagggtgggtagggcaaggaggggagtta

SEQ ID NO: 5161 - DNA, 683 bp, Homo sapiens
  misc_feature (1)...(683): n = A,T,C or G
atacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcnrcagggctgccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaaaaa

SEQ ID NO: 5162 - DNA, 578 bp, Homo sapiens
  misc_feature (1)...(578): n = A,T,C or G
ctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccstaggccacaatcagagaatggaattcctaggtgactccataatgcaacgtggtagccacagagtacttattcattcatttcccagatcatcatgaaggacacttaactttgttgcgaacgtcgtttggtgaatnatagaactccaggccaagctagcggaggagctgggcatgcaggagtacgccataaccaaccgacaagaccaagaggcctgtggggcttcgcaccaagaccttgggcgg

SEQ ID NO: 5163 - DNA, 395 bp, Homo sapiens
cagaaattcaaataattcttttctgcttcaatgccagcagaaggtcccccaggtagacatggagaagcactttgttttaaataggagggtttcatagttgcatctgaagccacctggttctgttwawstgttrtcgtgcaggtwkwgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattcc

SEQ ID NO: 5164 - DNA, 300 bp, Homo sapiens; identical to SEQ ID NO: 1203

SEQ ID NO: 5165 - DNA, 300 bp, Homo sapiens; identical to SEQ ID NO: 1205

SEQ ID NO: 5166 - DNA, 655 bp, Homo sapiens
ccattgttagcatcgtacacgattgtgatttttatgtcaaaagaagccaaaacttgcaatactatttttagcagacaaaaaaaagaactaagtataaaatgtataaatatttttgacttgaacatttggatggcactgggtsmamgtagagcatccatccttcggatgraatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaaaaaaaaaaaaaaaaaaaaaaaa

SEQ ID NO: 5167 - DNA, 300 bp, Homo sapiens
cacctgtgcccccaggctcaaggtctctggcaggtgcacaccagcccaactctgcagggcttctytccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccc

SEQ ID NO: 5168 - DNA, 345 bp, Homo sapiens
ttacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattcccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctccaaaaaaaaaa

SEQ ID NO: 5169 - DNA, 703 bp, Homo sapiens
  misc_feature (1)...(703): n = A,T,C or G
cgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgwacysgtsgygrsagmcrycagmgcggaaggtgtctgtgtataaaaatgatgacagtcggccatggctcacctgttcctgccagggtaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagngnccagtctncaagcagcacatccctgccaacaccanggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcangtnngacagnctctcagtgactctggggncactnggtcttcctgaactgatggtgtctcagccaggtnggtgcgttttgcaattctnctgngt

SEQ ID NO: 5170 - DNA, 404 bp, Homo sapiens
acaaggacaagaaagaaagtacggttgcaacggctggctcgcatgcatgccgacatgatggaggatgttgaggaagtatatgccggagacatctgtgcattgtttggcattgactgtgctrgtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagcc

SEQ ID NO: 5171 - DNA, 300 bp, Homo sapiens; identical to SEQ ID NO: 480

SEQ ID NO: 5172 - DNA, 593 bp, Homo sapiens
  misc_feature (1)...(593): n = A,T,C or G
agcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggraggraccaggaatgttgttgctggaatgtctagggaaaactcactctaattgatccaggaaactcttccttccacggstttaagggggtactttgattcagggttnattcatnattgncccgaaggttcagtgggtttacgggctgttgaaattttnacaattttcttgnaccctntccaca

SEQ ID NO: 5173 - DNA, 447 bp, Homo sapiens
  misc_feature (1)...(447): n = A,T,C or G
gacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtaggattctggtgcatctgcaataactygagaaagccacacacatagggatcggccatcacaacagcagcctcttcggaaatcaggtgggttagctcaaccaatgggagagctggatgttggatgatccccacgggagccccantcccaatggcacccattcacagcttcatgcccgaggtgggaggtagt

SEQ ID NO: 5174 - DNA, 1170 bp, Homo sapiens
gggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcattcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattccccgaatctgatgcaaaggacaacacaccctagagattgtaacagtgagatgaaccaagtgattggatggggttttgagttgctggaataatggagttacagtgtacaatgcataagcaacataataaattatatatctggtgaac

SEQ ID NO: 5175 - DNA, 301 bp, Homo sapiens
cgccgcacagctgctgaatgscttggrrytwgstggygcrttwcmkcrmsymgsrcstgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggct

SEQ ID NO: 5176 - DNA, 349 bp, Homo sapiens
ctgagatctgcttttactgaagtggatcaatgatgaaactagccaaatctgagcatcagaagkctttccrgtctacctgatgcatgatctctacagttctgagaagcaraactataaaacaatgtaaaacaataagggcatatgtctggtgtgtgtgtgtgtgtgtgkgkgtgtgtgtgtgtgtgyacscacaygtgtttataaagrtarcagytgtaggaatgaatgagattgrgggtgrgggggtgcrtatgtatgtctatgaaagcctaatcatttctgggcaatgatgwaaaggttttackactgatctttgtaactatgatggtttctacacttgacctgggct

SEQ ID NO: 5177 - DNA, 907 bp, Homo sapiens
gctgtacggagagtgctggaccgaggggagctgggagcaggtactgcctccatcctgagctgccgtcctttgaagggagaacctggggtagggttcgaggagcctggcragaactgtgcacctcctcgggaggagcagccccctcctgtgctgctttccccctcccttcaatatgctggggcggagacyckggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcattgggactctgagtggcgactgctccacctcattcccgtgactcgtggcatgcgcaggtgctggarcttggcagccgcgcaggagcatgtaggcaggctctcagatgtaggtggcaagtggcacagctccatgtccggaggcccagcactccgtctgatgggaggagycgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagaaaaaaaa

SEQ ID NO: 5178 - DNA, 865 bp, Homo sapiens
  misc_feature (1)...(865): n = A,T,C or G
acttttttaacgaatgggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggmtyytyagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccawtttgccaaactctgcatttcatttcatctaanggyttargcccctcttncttccgggggttanccgtg

SEQ ID NO: 5179 - DNA, 952 bp, Homo sapiens
tgcaacatcactgatatcagcatcctttaaaatattatctgmywcttgttctragagcmasaaagctgggaattcyttgayaragtkawkmasaatgcmkmcawaatgaatgcatgyasrctrytrtggtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattacccagtctcgggtatttcttcatagcagtgtgagaatggattaatacctggatgcatgcatgtttgtgtaacaaacaggtcttttggcttatctagtaagta

SEQ ID NO: 5180 - DNA, 657 bp, Homo sapiens
gtatcacctgagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctggaagagactcttttctaacagttctgtagcattaattatactcatactgttgtgcaacaaatatccagaaatcttttgtcttgcgaaactgaacctcttacccattaaacactaactcccttttttttcaccctgaaccatkggcaaccacaattttactttctttttctgtgagtttgattacttgatacttcatgtgagtggaatcatataatayyystctttytgtgactgacattttatttagcttaatgtcttcaagtttgacccataccatatcatgtggcaggatttttccctttttttttttttcagacggrgytcgytctgtcgccaggtgg

SEQ ID NO: 5181 - DNA, 969 bp, Homo sapiens
  misc_feature (1)...(969): n = A,T,C or G
ctgggagcgagacggtggcccggcccagccccatgggccacaccggctggtgagacgagaggatggggcagcaggggaccgggacctgcgggcagctgtggtgaatcaggacgctgaggagccaggaggcctkcctggaggcggtgctacgtcgactacaggsacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggcaggtggcgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctggcagttggtggccagtgtagggctggccaggtnctggaggacatgcataccccagcactggtgagtggcaggaccacggggaggtggcacaggcctccctggagcnggattatctcggccccgccccccttcatttgggctcccgctgtgggcctggcctgggctgtgagcacagcttgccccnacctccggccatggctgtgnctggtgggtncgccggatgggagcccggggctcttgcttcctttncccgggaagttggttgcttccgggtngggaggnacagcattggnacaagaggggttttntttccanaggctgttcaagcaaagttnaagttgattccctgacaaagaagcatntgttttcccggngaacttgc

SEQ ID NO: 5182 - DNA, 280 bp, Homo sapiens
gaggagttaaattttgaagctctttgagaaaggtaccttttcttaacatgttkkwtaaataaaaatacaatggcttatttaaaatgtccctatgcatggtgaaatgttaaataccaagtggatgaatggttctcaaatatattgtaatggagaattattcacatgcatctattgtttaaactaataagtaaaatagacttcctttttctgttctgttttaaatgtgcactaaaattacctgcttgtggttaagcatgggctggacagtttattgattttt

SEQ ID NO: 5183 - DNA, 758 bp, Homo sapiens
gccacacgggcccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttkgtttctcccctgggcagccaacctgccccagaggcaccagacctgggctttctagcttttgggaccaggctgcccaaaggtactcctttatacacccggcaccttccacggagatgggtactttcccaagcaagcccc

SEQ ID NO: 5184 - DNA, 300 bp, Homo sapiens; identical to SEQ ID NO: 526

SEQ ID NO: 5185 - DNA, 333 bp, Homo sapiens
atccagagaaatgatgtgccttgtgtaaagttgtggttaggaagggacagagccaggactctaaattctgtcctccggccataattccaaaactttctccaatgttaggtatgtaggctaaaatgtgctaacagcacttgtgtttttgtttccttttgttttactttttattatggcaaatttcaaacatatacagatacagaatagtttaatgaactcccatgttctcatcatgccagttcaaacatgaatacatggtcaaccttgtatcacttaaactcytgcasacaagccctgccccatcctgttgttttgaataaaatccatcattgt

SEQ ID NO: 5186 - DNA, 555 bp, Homo sapiens
aaaacactatttacctattttccaaggaaggaagtattgagattgacattccagtccccaaatacttatcttctgtgagctcacaagaaactcagggcggcccccttagctcctatgactggaacccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 5187 - DNA, 1029 bp, Homo sapiens
aacaggaatatggaaagaaactcagagccgagttagtggaaaagtggaaagcagagagagaggctcggctggcaagaggagaaaaggaagaggaggaggaagaggaggaagrgatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctkcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcaagtgcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagcaagactcgtgccattgcactccagcctggcgacagagtgagactctgtccccccac

SEQ ID NO: 5188 - DNA, 416 bp, Homo sapiens
  misc_feature (1)...(416): n = A,T,C or G
gnnctatagaatacaagctacttgttctttttgcnggancccwtckagwskgaattatagtattgacgtgaatcccactgtggtatagattccataatatgcttgaatattatgatatrgccatttaataacattgatttcattctgtttaatgaatttggaaatatgcactgaaagaaatgtaaaacatttagaatagctcgtgttatggaaaaaagtgcactgaatttattagacamacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttt

SEQ ID NO: 5189 - DNA, 572 bp, Homo sapiens
  misc_feature (1)...(572): n = A,T,C or G
aatggcctgcctcacacgtcagccagaacccagctgccccagtcaatgaagattatgcakgagatcatgtacaaactggaagtgctctatgtcctctgcgtgctgctgatggggcgtcagsraaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtgggaagctgtccttcaacaccgacaggagtttgggtgtgtgatggggaagagggggcttatttaactcgtctggttgcaggttcatggaagaagggagccagcaggagtcgtcttttcaggttttnggcaagctcggggntgttgggagagttttcctcccgaggggaccacct

SEQ ID NO: 5190 - DNA, 300 bp, Homo sapiens; identical to SEQ ID NO: 545

SEQ ID NO: 5191 - DNA, 553 bp, Homo sapiens
ggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggtatgtaatgtcagtgatgtaatgagctggtgattcactttcttcctttttattttcatgtatttgagggtaagcacagaacttcagaaatgtatttggatttgccattttgttttctgaatttctaatgatgaattttctgactggtttactcgtagtttatcctggtttgca

SEQ ID NO: 5192 - DNA, 300 bp, Homo sapiens; identical to SEQ ID NO: 548

SEQ ID NO: 5193 - DNA, 300 bp, Homo sapiens; identical to SEQ ID NO: 550

SEQ ID NO: 5194 - DNA, 575 bp, Homo sapiens
ggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttscctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 5195 - DNA, 477 bp, Homo sapiens
  misc_feature (1)...(477): n = A,T,C or G
aagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacacctttttacctggacacctggaggccagtgggtgggccccccaacaggcccaatctggttaytcagtccagcctattcaggcagagaggcagatgggggacaattgtttgacgcgggttcnggggtgattaaggaggaanttt

SEQ ID NO: 5196 - DNA, 555 bp, Homo sapiens
  misc_feature (1)...(555): n = A,T,C or G
cccaggatgaactggttgcagtggctgctgctgctgcgggggcgctgagaggacacgagctctatgcctttccggctgctcatcccgctcggcctcctgtgygcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccagggacagcgtgggactttgatattgatgtgaacgcctctgtgtttgaaacaaacattcgagtggtagggaggactcctgtcttgttcatctgcttttccaagaaggctggggtgggaagtagaggctggatgggcctgtttccggggcttttccttgagaattggctnagganggcggcccgaaaat

SEQ ID NO: 5197 - DNA, 1175 bp, Homo sapiens
  misc_feature (1)...(1175): n = A,T,C or G
agattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgrgrgaaatwaaccaactggccytggaaagaaggcaggcmaagctgctgagtaatagtcagaccctrggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatggggcttgtcactttagttaaatctatttgtnctctttagtgtttgtttttatataggtatttcttcataaaatgattaggaggtaatangcagtttctgctgctggtctgtcattgaatgccttgttttcactaagttgggaggtttggtt

SEQ ID NO: 5198 - DNA, 752 bp, Homo sapiens
gtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagca

SEQ ID NO: 5199 - DNA, 300 bp, Homo sapiens; identical to SEQ ID NO: 576

SEQ ID NO: 5200 - DNA, 530 bp, Homo sapiens
ggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtrggcagtgaggaggcggacagcatcaccttgggccggtatctccggcagctggcacgccatcggaacttcctgtggttcgtgagcatggacctggtgcaggtcttscastgscwctwcrmcwgyaayyycwkcmctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccactcagcctgctgtgcctcttcat

SEQ ID NO: 5201 - DNA, 837 bp, Homo sapiens
atacactgcatttgctggtgctgtttttatatagtgaagcaacagctgtacagcaaaataataaaatactcacttcttcgttaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccaraaggctccgcyyccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgattaaaaaaaaaaaaaa

SEQ ID NO: 5202 - DNA, 589 bp, Homo sapiens
  misc_feature (1)...(589): n = A,T,C or G
caagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttarwwcrgcwsaragaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatactttcttcagtgcctcaggacagaaaaacttgagaattattttattcctgaattcaatctattctctagcaacttaattgacaaaagaagtaaggaatttctgacaaagcaaattgaatatgaaagaaacaatgagtttccagtttttgatgaattttgagattgtattttttagaaagatctaagaactagagtcaccctaaatcctgggagawtacaagawaaatttggaaaaggggccagacgctgtggcttcacacctgtagttcccagcttcttttgggngggcc

SEQ ID NO: 5203 - DNA, 551 bp, Homo sapiens
gcatttggcccattggccgcattctgctgacccatcaccttggtgctttttctgctttttctcygtygtmctctgtgtgtgttcctttgtcctgatccttgtcaccttgtgggtccaaaatggttccactagcctcatggagcctggccttacattgcagagtccaaagcaggagctgagggaaaatgaaaaacaacttcttcatcaccggaagcccagcaaacttctccttaaaaatcactggtcagggctgggtgcagtggctcacacttgtaatgccagcactttgggaggctgagatgggcagatcacctgaggtgaggagttcgagaccagcctggccaacatggtgaaacctcatctctacaaaaatgcaaaaattagccgggcctggtggcgtgtgcctgtaatcccagctactcaggaggctgaggcaggagaatttcatgaacctgggaggcggaggttgcagtgagccaagactgtgccactgccttccagcctgggtgacagaatgmgactctatctttaraaacacaaaacaagtcgac

SEQ ID NO: 5204 - DNA, 345 bp, Homo sapiens
gtccagaaatactctgatactagctatggtcagcaacatttaatgaaaacscttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgmccgcctmggcctcccaragtgctgagattacaggcgtgagtcactgtgcccggcctcaaaatsttargaaaaggttcttttgggtgcatggagttttacatgggaataaattagt

SEQ ID NO: 5205 - DNA, 458 bp, Homo sapiens
ggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtkcagatcactgtgtccactactatgatcttcgtaacactaaacagccawtcatggtattcaaaggacaccgtwaagcagtctcttatgcaaagtttttgagtggtt

SEQ ID NO: 5206 - DNA, 548 bp, Homo sapiens
  misc_feature (1)...(548): n = A,T,C or G
atggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatgggacactgtataatttgggttaagactgctgaggccaagtgctattttgttacaggaaagggaggaacttgggctattttcttggacacttttatgggggtgctggcactttattttttgttccggtttttgtnggggnggg

SEQ ID NO: 5207 - DNA, 934 bp, Homo sapiens
  misc_feature (1)...(934): n = A,T,C or G
aaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagtgrntcgtgtgggcagcagatcgccaggcggcattgacaaaactgaggtacagccttcgtcagtacaatattgttggactgcmcaccaacattgacttcttactcaacctgtctggccacccagagtttgaagctkggaacgtgcacactgatttcatccctcaacaccacaaacagttgttgctcagtcggaaggctgcagcaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacagttttcgtctcctcggataatcaaccatttccatactcatgtaatctaggcatactctggagttattacaggtttggttccagaccactacaataaaatgtagccatagctgtaacgtataaccatgatgggtcttatagcatgcagattgaagaaaactttccaagtccttgggtaatctttacagccgagggagactgcacttacctgaaatgttccgttaatgggagttgc

SEQ ID NO: 5208 - DNA, 934 bp, Homo sapiens
gttagctcgaggggcaaataaagagcacaggaatkwwtctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactkaagtggttagtcttctgcttgatagaaaagcaaatgttgaacacagagctaagactggtctcacaccaytaatggaggctgcctctggtggatatgcggaggtggccgagttcttttggataaagatgctgatgttaatgccctccagttcctcctcaagagatacagctttaaccatagcagcagataagkgcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagag

SEQ ID NO: 5209 - DNA, 300 bp, Homo sapiens; identical to SEQ ID NO: 1400

SEQ ID NO: 5210 - DNA, 711 bp, Homo sapiens
ccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctgggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagt

SEQ ID NO: 5211 - DNA, 839 bp, Homo sapiens
tcaaggcctacgaacaggtgatgcactaccccggctacggttcccccatgcctggcagcttggccatgggcccggtcacgaacaaaacgggcctggacgcctcgcccctggccgcagataccttcctactaccagggggtgtactcccggccccatttatgaactcctcttaagaagacgacggcttcaggcccggctaactctggcaccccggatcgaggayaagtgagagagcaagtgggggtcgagactttggggagacggtgttgcagagacgcaagggagaagaaatccataacacccccaccccaacacccccaagacagcagtcttccttcacccgctgcagcygttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggtttt

SEQ ID NO: 5212 - DNA, 603 bp, Homo sapiens
  misc_feature (1)...(603): n = A,T,C or G
agaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacnttnaancagngggttttctgaccangaatatggctnggattttttngaaagtacaaaangccacatagtttttccagaaaggtttcaaaactcccaaagattaacttccaacttataagtttgtttttattttcaatctatgacttgactgggtattaaagccgctatttggatagtaattaaatatggtggtcattgatataaaccngtttggggtcagcaaaccaacctaaatggatggcnaagaccgngggtttaattttcccggtgggggtg

SEQ ID NO: 5213 - DNA, 300 bp, Homo sapiens
ccaaggcgcagcccgattctgccccctacgattggttcggggacttctcctccttccgtgccctcctagagccggagctgcggcccgaggaccgtatccttgtgctakgttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccattgatgtgcggaagctggacttccccagtgcttcttttgatgtggtgctcgaga

SEQ ID NO: 5214 - DNA, 492 bp, Homo sapiens
  misc_feature (1)...(492): n = A,T,C or G
gagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccncagcatgggcaggaagaagaggaacaggacaaaggctaaggtcccagcccaggcaaacgggacgccaaccaccaagagtccagcccctggcgcccncacccggagccccagcacccctgccaaatccccaaaactgcagaagaaaaaccagaagccgtcccaggtgaat

SEQ ID NO: 5215 - DNA, 1011 bp, Homo sapiens
gcaaggcgccgggggacacgttggctgcgttttcggcggactggccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcag

SEQ ID NO: 5216 - DNA, 300 bp, Homo sapiens; identical to SEQ ID NO: 1488

SEQ ID NO: 5217 - DNA, 1544 bp, Homo sapiens
  misc_feature (1)...(1544): n = A,T,C or G
cgggactggtaccaccgcatcgaccccaccgtgctgctgggcgcgctgcgcgttgcggagcttgacgcgccagctggtacaggacgagaacgtgcgcggggtgatcaccatgaacgaggagtacgagacgaggttcctgtgcaactcttcacaggagtggaagagactaggagtcgagcagckgcrscgwsrgcacagtagacatgactgggatccccaccttggacaacctccagaagggagtccaatttgctctcaagtaccagtcgctgggccagtgtgtttacgtgcattgtaaggctgggcgctccaggagtnccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacanggcttaagcccagacttgacgtaacagaaatgtgccaataggtaataggtaatttttctttctctgacttgttttgttttcttgaaataacactgttgtgtggctagaaaggaaaagatttagtgtggcttgtattcaygggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacacccccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcaggcttaggtccattctcctaagtaaagcctgaaggaaaactcttaacacctaattctttgtgggaaaaatgatcaactaggccatttcacaggctwtagaacmaaagtacmattgggcatctttccytatgtcckgggatcaggggwgcttacatttaacattgatcaggtaaagaggagaggctgtgctaaggtctgagaaaag

SEQ ID NO: 5218 - DNA, 948 bp, Homo sapiens
ggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcag

SEQ ID NO: 5219 - DNA, 300 bp, Homo sapiens; identical to SEQ ID NO: 1529

SEQ ID NO: 5220 - DNA, 1043 bp, Homo sapiens
  misc_feature (1)...(1043): n = A,T,C or G
taaaaaaccaccttttgttcgaaactccctggagcgacgcagcgtccggatgaagcggccgtccccacccccacatccttcctcggtcaagtcgctgcgctccgagcgtctgatccgtacctcgctggacctggagttagascwssaggcgacaagaacctggcacagccaattgacccaggagatctcggtgctgaakgagctcaaggagcagctggaacaagccaagagccacggggagaaggagctgccacagtggttgcgtgaggackagcgtttccgcctgctgctgaggatgctggagaagcggcagatggaccgagcggacacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttkttccaytgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttyytsgttgtacagctccaccttttagaggtcttactgcaataagaagtaatgcctgggggacggtaatcctaataggacgtcccgcacttgtcacagtacagctaatttttcctagttaacaatttgtcatattammmmntgcacagammaccattgggggggattcagaggtgcatccaccccggntcttcttgagctg

SEQ ID NO: 5221 - DNA, 796 bp, Homo sapiens
  misc_feature (1)...(796): n = A,T,C or G
atcgattaacacttctaatgagtcaagtcctagggttttttggttttgttttgttgccaacgaggaacacagctctgggggaatggtgtcatccwcstgcgytttaaaaataagcacatgatggctgggcaccgtggctcacgcctgtaatcccagcactttgggaggctgaggcgggtggwtcacctgaggtcgggagtttgagaccagcctggccaacatggtgaaaccccatcgctactaaaawtataaaaaattagctgggcatggtggcgcacgyctgtagttccagctactcaggaggctgaggcaggagaatcgcttgaacccgggaggtggaggttgcagtgagctgagatcgcaccattgcactcccacctgggcaacaaagagtgaaacttggtctcagaaacgaaacaaaacacaaaaacctttctcagtcccagcatatgtggagcagcctcattcttcatagctgtgtgtcattccgttgcgtgatggggtcacagagcacagacctggtgcccttttcctttttaatatgtggaaacccctccatgctttccaaagcctacaagtacagcagccccaagtttagggtgagcagcagtggtcagagctctttactattacttttgggcaaacgcaagccaggctggcaaccaccactgccgccgaggggagatacaagcaggccagtttcacactytgggacktttagtttctttcttacatctagaaggtgggcctctkgttattccantttaaaggcagcccaagggaantgttcagnaaa

SEQ ID NO: 5222 - DNA, 328 bp, Homo sapiens
ataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtg

SEQ ID NO: 5223 - DNA, 302 bp, Homo sapiens
ggaagagctcgtcttggagtccaagcttttgccacttcaattgcaccagctccaggaaccatacaaccatcttcaatkgcatttttgatagcacgaagtccatctcttatggcatccttgacttgtgtgagagtcatgctttatttggtcctttaaccaacaaggtaacagagcaagggttaacacactcctcaataaaagtgaacttttcttcacctaatgtatactcatacacaagaccagcatgtcccaagcaatctacagtgagatcttcaaaagaattcacggccattccaccacaa

SEQ ID NO: 5224 - DNA, 551 bp, Homo sapiens
gcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccastgcattctccccctgacacagagaaggggccttggtatttatatttaagaaatgaagataatattaataatgatggaaggaagactgggttgcagggactgtggtctctccyggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctccaaaa

SEQ ID NO: 5225 - DNA, 555 bp, Homo sapiens
gctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgacctgtccaggaaggatkagwcscwgtrmtgtssactctttsmkcasctcmkwsswwkwwkmtrtgmccgcgggasctgsacarwwwsatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggactttgtagggccactggcaaacaatactcctcttgggccct

SEQ ID NO: 5226 - DNA, 498 bp, Homo sapiens
  misc_feature (1)...(498): n = A,T,C or G
attcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaawtsggwacgagkatttcatccccacttttatcaatgagaaactaaagctcgaagaggtcaagtaagttcctggccaaggtcagctagcaggctctagaggcctcgttctccttagaggcaagccttgccagggcccaggcttggcaggctgcagggcaggtgcgggcatgccatggtagaggtgggaccattgaggctcagagagggtaagtgatganccctggnacacagcggggtgggtccagagtccggcctgcatcttctggagctggccagtggacaggcctttcccgttcacaagcccggggctgctgttcccaccaaggggggaatgttgccta

SEQ ID NO: 5227 - DNA, 537 bp, Homo sapiens
ggatgggtgccctggagccaggcaaggcaggaggccccagaaacttggtgggggagataacggaggggatggagcaggaggaatcctgaaaaccggactgggagagatgkgrccsagtggasgakkyccrstaysasmkggcgtmtgagackgaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgtgccactgctcwccagcctgggtggcagarcgagaccctgtctcaaaaaaataacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 5228 - DNA, 735 bp, Homo sapiens
  misc_feature (1)...(735): n = A,T,C or G
ggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagaggagcagtgaggcaggacagatggacaggttcctcctgcgctgtaattccctgctccctggagactgggaaaaggccgcagnacgggggactgggcggtggtggctggtggtttaaaggttgaactttctctgaagctcctttcccctttgctcttggtccctgccccngcaangcaaacctgccccctctgcctcccagtgcacccaatgaccccccttccccttggggcggacttcctgattgaagcacaactcccccgcaagganccccaagcccacaagggttggccataatttggggcagtttccaagtcctgtnggcttcggctaatcntgggggangaagatttttngggtcttggatttcccttgggaaattgggtccttgggcttggaatnttttccctaagggggccctcttanttcctt

SEQ ID NO: 5229 - DNA, 317 bp, Homo sapiens
  misc_feature (1)...(317): n = A,T,C or G
ggctgcctggggaaggagaaatctgagccaagacctgacaaatgaataggagtaagctaaggaaagtgactggggtgagtgagttccaaatggagggaactgcatgtgcagaggcctggaggtgaggggaacctgggcacattccaggagctgaagggtttgttgtggctggaacataaagagccaaagggggccaagcagtgcttcacacctgtaatcccagcrctctgggaggcygaggtgggcagatcacctgaggtcaggagttcaagaccagcctggtcaacgtggtgaaaccctgtctctactnaaaatac

SEQ ID NO: 5230 - DNA, 300 bp, Homo sapiens; identical to SEQ ID NO: 1695

SEQ ID NO: 5231 - DNA, 300 bp, Homo sapiens; identical to SEQ ID NO: 548

SEQ ID NO: 5232 - DNA, 300 bp, Homo sapiens
ccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctakgttgcgggaacagtgccctgagctacgagctgttcctcggaggcttccctaatgtgaccagtgtggactact

SEQ ID NO: 5233 - DNA, 564 bp, Homo sapiens
  misc_feature (1)...(564): n = A,T,C or G
gcagcagctcccaggatgaactggttgcagtggctgctgctgctgcgggggcgctgagaggacacgagctctatgcctttccggctgctcatcccgctcggcctcctgtgygcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccagggacagcgtgggactttgatattgatgtgaacgcctctgtgtttgaaacaaacattcgagtggtagggaggactcctgtcttgttcatctgcttttccaagaaggctggggtgggaagtagaggctggatgggcctgtttccggggcttttccttgagaattggctnagganggcggcccgaaaat

SEQ ID NO: 5234 - DNA, 596 bp, Homo sapiens
  misc_feature (1)...(596): n = A,T,C or G
actcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaaagctgttctttcccacttagttaaaaggcaggccaaatggattcaccttcacctttggctaatgggagggcgtgggcaccntgcggcaccagtggggacn

SEQ ID NO: 5235 - DNA, 732 bp, Homo sapiens
  misc_feature (1)...(732): n = A,T,C or G
gcttcgtgtgctactgcgaaggggaggaaagcggggagggggaccgcggcggcttcaacctctacgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctcttggggtcgggcaggtttcgggtgcccccagtggcctcgggttccaggcagctcgtgacaagcccctgtgctctctagaaagcccgttttggcctgagtgcggctgaggacatcaccccccggttcagggcagcctgtgagcagcaagctgtggctctgactctgcaggaggacagagcatccctgacgctttcaggggggccctcggactggcctttgacctctccaaggtaccaggcccagaggcagcccccaggctgtgggcgctgacactgggcctggcaaaacgcgtgtggagcctggagcgkcgactkgcagctgcagaagagacagctgtcagcccgaggaagagcccccggcctgcagggcttcagctcttcttaccagacccagatccccagagaggttgccctggacctnggagtcaggatgncggtttccaggagaattcgttcatcnaa

SEQ ID NO: 5236 - DNA, 816 bp, Homo sapiens
  misc_feature (1)...(816): n = A,T,C or G
ctgaaacagggtcgggatgccgatgccggcttggagttagagrkkmgwcaccgctgagagcagctgcagtagctgagyagtggcagcagagaggcagacgtgagctgagggcgcagaggcaggcagcatctctgagggtccccaaggagcatggctgggagccgtgaggtggtggccatggactgcgagatggtggggctggggcccacngggnagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctcctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgccaaa

SEQ ID NO: 5237 - DNA, 817 bp, Homo sapiens
  misc_feature (1)...(817): n = A,T,C or G
agacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgyttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattktgggatttgcattcaaaaaggacactggtgatacaagagaatcttctagtatatatattagcaaatatttgatggatgaaggtgcacatctacatatatatgatccaaaagtacctaggggaacaaatagttgtgggatctttctcatccagggtgtttcagagggatgaccaagtgtccccggcttcgtgaccatttccaaggatccatatggaaggcatgtgatgggtgccccatgctgttgtttattttgcactgagtggggacatgttttaaggggatttgggattattggaccgcattccattaaaaaaatggcttaagnccagccctttatnctt

SEQ ID NO: 5238 - DNA, 337 bp, Homo sapiens
  misc_feature (1)...(337): n = A,T,C or G
gtgcaccggagggtgaagacagccctcgcgakgamkgwggaggcctggkgagcaggcctgaccctgtgryrswrcwksaggctgcggtgaagcgggccgaccacctggaggagctgctggagcarmmcaggaggcccacgmcaagtaccaagtgaccagggatgccgggaacactgtcgaagaacggaaggcagaggacagaggctggacgttggcccagagcagagagacgnccacctgccccccacagaggctggtggttnagatgcccacggttaagcacctgtggcttgcatttttaaacagttaaaaggaggccgttgttttcagcgccttt

SEQ ID NO: 5239 - DNA, 570 bp, Homo sapiens
  misc_feature (1)...(570): n = A,T,C or G
gacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatgggaggatttcgagatggctttaaaaaaggtttctaagtncagtgttcttgctggcagacatttgaaaggttacggggaatgggtattttgagtttgggtccntgctaaatttntcacctgtaaactgttgaggaatgtgccttaag

SEQ ID NO: 5240 - DNA, 907 bp, Homo sapiens
agccaatgtgcttgcaagtgtacagatctgtgtagaggaatgtgtgtatatttacctcttcgtttgctcaaacatgagtgggtatttttttgtttggtttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtrgagacagggttttaccatgttgsccaggctggycttgaactcctgaccctcaagtgatctgcccaccttggcctccctaagtgctgggattatagscgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatgg

SEQ ID NO: 5241 - DNA, 1184 bp, Homo sapiens
  misc_feature (1)...(1184): n = A,T,C or G
gcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatstmtcrcctttggagtacatgatgaagtgctacccagagataaaggagaaggaagaaatgaggaagatcattgggcgatacggtctnactgggaaacaacaggtgagcccaatccggaacttgtcagacgggcagaagtgccgagtgtgtctggcctggctggctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctgggagacatcctggcttacaaggagcacctcaagtccaagctggtggattgaggagccccagctcaccaagagkacccacaacgtgtgagccytytacctgggttcgggtcaggagctccatcntgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctgttatcttacatctgagtgtgatgcagtcagaggcacctgcgggttagcccaggggggcccaactgatttggcctgcggaggagcttaggatcctcgttttctgggttttggtgatgttggaggagtaccccccagcccaccgccccgattcctttttgcttctggtttggagctccggaccaggaccttcgtcctggtnagtttttaaataatt

SEQ ID NO: 5242 - DNA, 383 bp, Homo sapiens
  misc_feature (1)...(383): n = A,T,C or G
gtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcmsgccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggncaccttaccaggggactttta

SEQ ID NO: 5243 - DNA, 1278 bp, Homo sapiens
cacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagtagagagagtggagctgctttattgcccttggagcccgcgctctcggaggctgtcttctgtcgccaagggtcccggaccgagtacacagtggcagctggcttagttggtggacggcytggsscactcgacgttgaggatgaggtggtcgtagccaaagccggacaccccggcaatggcacgcgcagsatcctcgcggcggtggaagctgatgaaggcraagcccttggattggccagtggtcttgtccttagccaggtagatgcgggagatggagccgaaaggcsggaagagctcctgcaggtcggtctcacgcgtgtcctctgacaagttggtgacacggatggtggcgttgtcgtcggctctgcggttgggctgcatggactccccgcggcggctggccccgtcgcgmaggctcggcggmacatacttccctgtcttgttctgcgtggcctgcacgggctctagctctcccggcagcttctccttctcgccagtaracaggcccagctgctcggccagctccttctgcatgggccccagcgtatccttgtaggggcagcgggtggtccagtggtcgcccttgcagatgcggcaggacacgatcttctggcccttgagtttgttcatagggtcctcctcctcctggcagttcaggtcctctttgctggtgatgaacgtcatagagacatcgtcactgacagtggtggtggccacattgggtccgggggggtcaaactctgagttcccgaacttcttccagttcttcctccttgcgacagcctttgaagccttccgggtctcaatcctgaaggtgcggacaatcttgaacttcttgccatcctcattttctatcttgtactctgtcactgtctttatgtttccgttgatgacctccttgggaggcggcagtggagctcccggcagtagctctggctctgggctggtgtcacctgtggccagagggatccccttgaggagctcgctggtgacacatttgtcgtcctccccctcctcctccacctggtcggcccaactgggcttcgaatyaaagtctccagtaggcatcgcaaaaagtattctccacgcagcccaagcccgg

SEQ ID NO: 5244 - DNA, 300 bp, Homo sapiens; identical to SEQ ID NO: 1921

SEQ ID NO: 5245 - DNA, 496 bp, Homo sapiens
attctctctccataccaccccccaaaaattttcgccgctccaacacttcaacactattttgktttatttgtcttattaatatmagaaggcaggaatgtcaggcctctgagcccaggccaggccatcgcatcccctgtgacttgcacgtatacatccagatggcctgaagtaactgaagatccacaaaagaagtaaaaacagccttaactgatgacattccamcattgtgatttgttcctgccccaccctaactgatmaatgtactttgtaatctcccccacccttaagaaggtyctttgtaattctccccacccttgagagtgtactttgtgagatccacacctgcccaccagagaacaaaccccytttgactgtaattttccattaccttccctaatcctataaaacggccccaccccatctccctttgctgactctcttttcggactcagcccgcctgcacccaggtgaaataaacagccttgttgctcacaca

SEQ ID NO: 5246 - DNA, 300 bp, Homo sapiens; identical to SEQ ID NO: 1942

SEQ ID NO: 5247 - DNA, 300 bp, Homo sapiens; identical to SEQ ID NO: 1958

SEQ ID NO: 5248 - DNA, 507 bp, Homo sapiens
agggggcgggcccgtacgccgattccatatgggcgccggcgcggagcgccgcggggcagcgcggggtcgccatggctgagctgcagcagctccgggtgcaggaggcggtggagtccatggtgaagagtctggaaagagmgrwcmtsckkmwswyrcrgaggtctcatgttccggtgcagcgccagctgttgtgaggacagccaggcctccatgaagcaggtgcaccagtgcatcgagcgctgccatgykcctctggctcaagcccaggctttggtcaccagtgagctggagaagttccaggaccgcctggcccggtgcaccatgcattgcaacgacaaagccaaagattcaatagatgctgggcgtaaggagcttcaggtgaagcagcagctggacagttgtgtgaccaagtgtgtggatgaccacatgcacctcatcccaactatgaccaagaagatgaaggaggctctcttatcaattggaaaataaaagtatcttccagtggcc

SEQ ID NO: 5249 - DNA, 1718 bp, Homo sapiens
cacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaaaaagacataggacttaactggaaaatgaaaaaaaaaagaaaaagraaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatcaaaaaaaaaaagtcgacc

SEQ ID NO: 5250 - DNA, 426 bp, Homo sapiens
  misc_feature (1)...(426): n = A,T,C or G
cccgacggtgtgtgggcacacgggacctgtcctggacatcgactggtgtcctcacaacgacgaagymrtagccagcggctcgtgaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagancgggagaagg

SEQ ID NO: 5251 - DNA, 538 bp, Homo sapiens
  misc_feature (1)...(538): n = A,T,C or G
caccagtggctttagggcctgtcgcttacgcgatgcgggtagtattgttcccgttgcgcagttgaggacacctaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggmawttggatcagaagtcgcagctctggtgggaggaaggcgagtcctcatgtgtgtccctgtgccactttgccttgnccctttgctgtccatcctttttcagggcgtggactccctggtgctagaaagcgtgatgttcgccatacttgcggacgggtccgctggggccccagcttgtacggagtctttcccagaaggcccggcttggaacagtacatcccaagtcnggccatttgaaaacttcaaagaagcttcgagaagccagtgttgtcagcagcca

SEQ ID NO: 5252 - DNA, 1603 bp, Homo sapiens
  misc_feature (1)...(1603): n = A,T,C or G
gctcttctctgtgccctttatccgcacttcccagctcacagcactgacaaccggtatcatctccaggctctccggcacctctatgtgctggccgcggagcccaggcttctagtgmytskgsaygayggacacaaacacgccctgctatgccctcttagaagttacctacaagggcactcagtggtatgaacaaaccawagaagaattgatggctcctacccttcttccagaactccatcttttaaagcacgattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagcagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatggggccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtgggtataggtgaagtgactatgcccaaaaatgccaagttttaaaagaagctatgtcataaagttttactttctgtgggcaaaagagcgctttagccatttcctcagatgtcacagttgtccccgtctaaaataagtttgtacttctgggtgaccatgnccagacactcttatggaggtgatcccccttaac
